United States Patent
Ward et al.

(10) Patent No.: US 12,486,512 B2
(45) Date of Patent: Dec. 2, 2025

(54) SOLUTE CARRIER FAMILY MEMBER iRNA COMPOSITIONS AND METHODS OF USE THEREOF

(71) Applicant: Alnylam Pharmaceuticals, Inc., Cambridge, MA (US)

(72) Inventors: Lucas D. Ward, Cambridge, MA (US); Ho-Chou Tu, Cambridge, MA (US); James D. McIninch, Cambridge, MA (US); Paul Nioi, Cambridge, MA (US)

(73) Assignee: Alnylam Pharmaceuticals, Inc., Cambridge, MA (US)

( * ) Notice: Subject to any disclaimer, the term of this patent is extended or adjusted under 35 U.S.C. 154(b) by 436 days.

(21) Appl. No.: 17/768,914

(22) PCT Filed: Oct. 16, 2020

(86) PCT No.: PCT/US2020/055877
§ 371 (c)(1),
(2) Date: Apr. 14, 2022

(87) PCT Pub. No.: WO2021/076828
PCT Pub. Date: Apr. 22, 2021

(65) Prior Publication Data
US 2024/0141358 A1 May 2, 2024

Related U.S. Application Data

(60) Provisional application No. 62/916,996, filed on Oct. 18, 2019, provisional application No. 62/916,993, filed on Oct. 18, 2019.

(51) Int. Cl.
*C12N 15/11* (2006.01)
*C12N 15/113* (2010.01)

(52) U.S. Cl.
CPC ...... *C12N 15/1138* (2013.01); *C12N 2310/14* (2013.01); *C12N 2310/351* (2013.01)

(58) Field of Classification Search
None
See application file for complete search history.

(56) References Cited

FOREIGN PATENT DOCUMENTS

WO WO-2021/076828 A1 4/2021

OTHER PUBLICATIONS

Patrushev et al., Angiotensin II Requires Zinc and Downregulation of the Zinc Transporters ZnT3 and ZnT10 to Induce Senescence of Vascular Smooth Muscle Cells, PLoS One, 2012, vol. 7, issue 3, e33211: 1-13 (Year: 2012).*
Foster et al., "Advanced siRNA Designs Further Improve In Vivo Performance of GalNAc-siRNA Conjugates", Mol Ther. Mar. 7, 2018;26(3):708-717.
Ui-Tei et al., "Functional dissection of siRNA sequence by systematic DNA substitution: modified siRNA with a DNA seed arm is a powerful tool for mammalian gene silencing with significantly reduced off-target effect", Nucleic Acids Res. Apr. 2008;36(7):2136-51.
Chernikov et al., "Current Development of siRNA Bioconjugates: From Research to the Clinic", Front Pharmacol. Apr. 26, 2019:10:444.
Hu et al., "Therapeutic siRNA: state of the art", Signal Transduction and Targeted Therapy (2020) 5:101.
Nair et al., "Impact of enhanced metabolic stability on pharmacokinetics and pharmacodynamics of GalNAc-siRNA conjugates", Nucleic Acids Res. Nov. 2, 2017;45(19):10969-10977.
Shukla et al., "Exploring Chemical Modifications for siRNA Therapeutics: A Structural and Functional Outlook", ChemMedChem. Mar. 1, 2010;5(3):328-49.
Patrushev et al. "Angiotensin II requires Zinc and downregulation of the Zinc Transporters ZnT3 and ZnT10 to induce senescence of vascular smooth muscle cells", PLOS ONE, vol. 7, No. 3, Mar. 12, 2012, p. e33211.
Go et al., "Protective function of SLC30A 10 induced via PERK-ATF4 pathway against 1-methyl-4-phenylpyridinium", Biochemical and Biophysical Research Communications, vol. 490, No. 4, Jul. 5, 2017, pp. 1307-1313.
Fujishiro et al., "The role of ZIP8 down-regulation in cadmium-resistant metallothionein-null cells", Journal of Applied Toxicology, vol. 29, No. 5, Jul. 1, 2009, pp. 367-373.
Scheiber et al., "Manganese uptake by A549 cells is mediated by both ZIP8 and ZIP14", Nutrients, vol. 11, No. 7, Jun. 28, 2019, p. 1473.
Martin et al., "Long-term extracellular signal-related kinase activation following cadmium intoxication is negatively regulated by a protein kinase C-dependent pathway affecting cadmium transport: Cd-induced ERK activation is inhibited by PKC", FEBS Journal, vol. 276, No. 6, Feb. 13, 2009, pp. 1667-1679.
Mei et al., "Knockdown of zinc transporter ZIP8 expression inhibits neuroblastoma progression and metastasis in vitro", Molecular Medicine Reports, May 2, 2018, ISSN: 1791-2997.
Pae et al., "Insulin production hampered by intermittent hypoxia via impaired Zinc homeostasis", PLOS ONE, vol. 9, No. 2, Feb. 25, 2014, p. e90192.
Tanimura et al., "GATA/Heme multi-omics reveals a trace metal-dependent cellular differentiation mechanism", Developmental Cell, vol. 46, No. 5, Sep. 1, 2018, pp. 581-594.e4.
International Preliminary Report on Patentability from International Application No. PCT/US2020/055877, mailed Apr. 28, 2022.

(Continued)

*Primary Examiner* — Ekaterina Poliakova-Georgantas
(74) *Attorney, Agent, or Firm* — McCarter & English, LLP; Maria Laccotripe Zacharakis; Deborah L. Nagle

(57) ABSTRACT

The present invention relates to RNAi agents, e.g., double stranded RNA (dsRNA) agents, targeting a solute carrier family member gene, e.g., SLC30A10, or SLC39A8. The invention also relates to methods of using such RNAi agents to inhibit expression of a solute carrier family member gene, e.g., an SLC30A10 gene, or an SLC39A8 gene, and to methods of preventing and treating a solute carrier family member-associated disorder, e.g., a hypermanganesemia.

21 Claims, 3 Drawing Sheets
Specification includes a Sequence Listing.

(56) References Cited

OTHER PUBLICATIONS

Vickers et al., Efficient reduction of target RNAs by small interfering RNA and RNase H-dependent antisense agents. A comparative analysis. J Biol Chem. Feb. 28, 2003;278(9):7108-18.
Reynolds et al., Rational siRNA design for RNA interference. Nat Biotechnol. Mar. 2004;22(3):326-30.
Nair et al. "Multivalent N-Acetylgalactosamine-Conjugated siRNA Localizes in Hepatocytes and Elicits Robust RNAi-Mediated Gene Silencing" J. Am. Chem. Soc. 2014, 136, 16958-16961.

* cited by examiner

SOLUTE CARRIER FAMILY MEMBER iRNA COMPOSITIONS AND METHODS OF USE THEREOF

RELATED APPLICATIONS

This application is a 35 U.S.C. § 371 national stage filing of International Application No. PCT/US2020/055877, filed on Oct. 16, 2020, which claims the benefit of priority to U.S. Provisional Patent Application No. 62/916,993, filed on Oct. 18, 2019, and U.S. Provisional Patent Application No. 62/916,996, filed on Oct. 18, 2019. The entire contents of each of the foregoing patent applications are incorporated herein by reference.

SEQUENCE LISTING

The instant application contains a Sequence Listing which has been submitted electronically in ASCII format and is hereby incorporated by reference in its entirety. Said ASCII copy, created on Oct. 8, 2020, is named 121301-10720_SL.txt and is 645,062 bytes in size.

BACKGROUND OF THE INVENTION

Manganese (Mn) is an essential nutrient that acts as a cofactor for a variety of enzymes involved in numerous cellular physiological processes (Homing, K. J., et al. (2015) *Annu Rev Nutr* 35:71). However, when accumulated at high levels, Mn can be a potent toxicant to cells, as it increases oxidative stress, impairs mitochondrial function, and promotes cell death (Milatovic, D., et al. (2009) *Tox Appl Pharmacol* 240:219; Stanwood, G. D., et al. (2009) *J Neurochem* 110:378).

For example, neurotoxicity can occur following high dose oral, inhalation, or parenteral exposure to manganese. The development of neurotoxicity following different routes of exposure indicates that the dose to target tissue is the critical determinant of Mn toxicity, regardless of route.

In humans, Mn toxicity represents a serious health hazard, resulting in severe pathologies of the central nervous system. In its most severe form, the toxicosis is manifested by a permanent crippling neurological disorder of the extrapyramidal system, which is similar to Parkinson's disease. In its milder form, the toxicity is expressed by hyperirritability, violent acts, hallucinations, disturbances of libido, and incoordination. While the majority of reported cases of manganese toxicity occur in individuals exposed to high concentrations of airborne manganese (>5 mg m-3), subtle signs of manganese toxicity including delayed reaction time, impaired motor coordination, and impaired memory have been observed in workers exposed to airborne manganese concentrations lower than 1 mg m-3. Manganese toxicity has been reported in an individual who consumed high amounts of manganese supplements for several years and in individuals who have consumed water containing high levels of manganese. The current treatments for subjects having elevated levels of Mn, such as, manganism, have limited success and include chelation therapy with intravenous calcium edetate, supplementation with oral iron, antipasticity medications, levodopa, physiotherapy, and liver transplantation for subjects having end-stage liver disease.

The essential yet toxic nature of Mn necessitates precise homeostatic mechanisms to maintain appropriate levels of intracellular Mn. Thus, cells require efficient transport mechanisms for the uptake, intracellular distribution, and efflux of metal ions, such as Mn. Three transporters co-operate in Mn homeostasis, solute carrier family 30 member 10 (SLC30A10) effluxes Mn into bile, solute carrier family 39 member 14 (SLC39A14) is responsible for re-uptake of Mn into the liver, and solute carrier family 39 member 8 (SLC39A8) is responsible for re-uptake of Mn from bile and has been shown to regulate hepatic and extrahepatic Mn Levels (Lin, et al. (2017) *J Clin Invest* 1:127) (see FIG. 1). Thus, therapies which reduce the circulating levels of a solute carrier family member, e.g., SCL30A10 or SCL39A8, can be used to restore Mn balance in subjects having elevated levels of Mn, such as manganism, by increasing the urinary Mn without increasing blood Mn concentrations.

Accordingly, there is a need in the art for compositions and methods to treat subjects having a disorder associated with high levels of Mn, such as hypermanganesemia, by reducing levels of solute carrier family members, e.g., SLC30A10 and/or SLC39A8.

SUMMARY OF THE INVENTION

The present invention provides iRNA compositions which affect the RNA-induced silencing complex (RISC)-mediated cleavage of RNA transcripts of a gene encoding a solute carrier family member, e.g., solute carrier family 30 member 10 (SLC30A10), or solute carrier family 39 member 8 (SLC39A8). The solute carrier family member, e.g., SLC30A10 or SLC39A8, may be within a cell, e.g., a cell within a subject, such as a human subject.

In an aspect, the invention provides a double stranded ribonucleic acid (dsRNA) agent for inhibiting expression of solute carrier family 30 member 10 in a cell, wherein the dsRNA agent comprises a sense strand and an antisense strand forming a double stranded region, wherein the sense strand comprises at least 15 contiguous nucleotides differing by no more than 1, 2, or 3 nucleotides from the nucleotide sequence of any one of SEQ ID NOs:1-5 and the antisense strand comprises at least 15 contiguous nucleotides differing by no more than 1, 2, or 3 nucleotides from the nucleotide sequence of any one of SEQ ID NOs:6-10.

In another aspect, the present invention provides a double stranded ribonucleic acid (dsRNA) agent for inhibiting expression of solute carrier family 30 member 10 in a cell, wherein said dsRNA agent comprises a sense strand and an antisense strand forming a double stranded region, wherein the antisense strand comprises a region of complementarity to an mRNA encoding solute carrier family 30 member 10, and wherein the region of complementarity comprises at least 15 contiguous nucleotides differing by no more than 1, 2, or 3 nucleotides from any one of the antisense nucleotide sequences in any one of Tables 2-3.

In an aspect, the invention provides a double stranded ribonucleic acid (dsRNA) agent for inhibiting expression of solute carrier family 39 member 8 in a cell, wherein the dsRNA agent comprises a sense strand and an antisense strand forming a double stranded region, wherein the sense strand comprises at least 15 contiguous nucleotides differing by no more than 1, 2, or 3 nucleotides from the nucleotide sequence of any one of SEQ ID NOs:11-14 and the antisense strand comprises at least 15 contiguous nucleotides differing by no more than 1, 2, or 3 nucleotides from the nucleotide sequence of any one of SEQ ID NOs:15-18.

In another aspect, the present invention provides a double stranded ribonucleic acid (dsRNA) agent for inhibiting expression of solute carrier family 39 member 8 in a cell, wherein said dsRNA agent comprises a sense strand and an antisense strand forming a double stranded region, wherein the antisense strand comprises a region of complementarity to an mRNA encoding solute carrier family 39 member 8, and wherein the region of complementarity comprises at least 15 contiguous nucleotides differing by no more than 1, 2, or 3 nucleotides from any one of the antisense nucleotide sequences in any one of Tables 4-9.

In one embodiment, the dsRNA agent comprises at least one modified nucleotide.

In one embodiment, substantially all of the nucleotides of the sense strand comprise a modification; substantially all of the nucleotides of the antisense strand comprise a modification; or substantially all of the nucleotides of the sense strand and substantially all of the nucleotides of the antisense strand comprise a modification.

In one embodiment, all of the nucleotides of the sense strand comprise a modification; all of the nucleotides of the antisense strand comprise a modification; or all of the nucleotides of the sense strand and all of the nucleotides of the antisense strand comprise a modification.

In one embodiment, at least one of the modified nucleotides is selected from the group consisting of a deoxy-nucleotide, a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxly-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, a nucleotide comprising a 5'-phosphate mimic, a thermally destabilizing nucleotide, a glycol modified nucleotide (GNA), and a 2-O—(N-methylacetamide) modified nucleotide; and combinations thereof.

In one embodiment, the modifications on the nucleotides are selected from the group consisting of LNA, HNA, CeNA, 2'-methoxyethyl, 2'-O-alkyl, 2'-O-allyl, 2'-C-allyl, 2'-fluoro, 2'-deoxy, 2'-hydroxyl, and glycol; and combinations thereof.

In one embodiment, at least one of the modified nucleotides is selected from the group consisting of a deoxy-nucleotide, a 2'-O-methyl modified nucleotide, a 2'-fluoro modified nucleotide, a 2'-deoxy-modified nucleotide, a glycol modified nucleotide (GNA), and, a vinyl-phosphonate nucleotide; and combinations thereof.

In another embodiment, at least one of the modifications on the nucleotides is a thermally destabilizing nucleotide modification.

In one embodiment, the thermally destabilizing nucleotide modification is selected from the group consisting of an abasic modification; a mismatch with the opposing nucleotide in the duplex; and destabilizing sugar modification, a 2'-deoxy modification, an acyclic nucleotide, an unlocked nucleic acids (UNA), and a glycerol nucleic acid (GNA)

The double stranded region may be 19-30 nucleotide pairs in length; 19-25 nucleotide pairs in length; 19-23 nucleotide pairs in length; 23-27 nucleotide pairs in length; or 21-23 nucleotide pairs in length.

In one embodiment, each strand is independently no more than 30 nucleotides in length.

In one embodiment, the sense strand is 21 nucleotides in length and the antisense strand is 23 nucleotides in length.

The region of complementarity may be at least 17 nucleotides in length; between 19 and 23 nucleotides in length; or 19 nucleotides in length.

In one embodiment, at least one strand comprises a 3' overhang of at least 1 nucleotide. In another embodiment, at least one strand comprises a 3' overhang of at least 2 nucleotides.

In one embodiment, the dsRNA agent further comprises a ligand.

In one embodiment, the ligand is conjugated to the 3' end of the sense strand of the dsRNA agent.

In one embodiment, the ligand is an N-acetylgalactosamine (GalNAc) derivative.

In one embodiment, the ligand is one or more GalNAc derivatives attached through a monovalent, bivalent, or trivalent branched linker.

In one embodiment, the ligand is

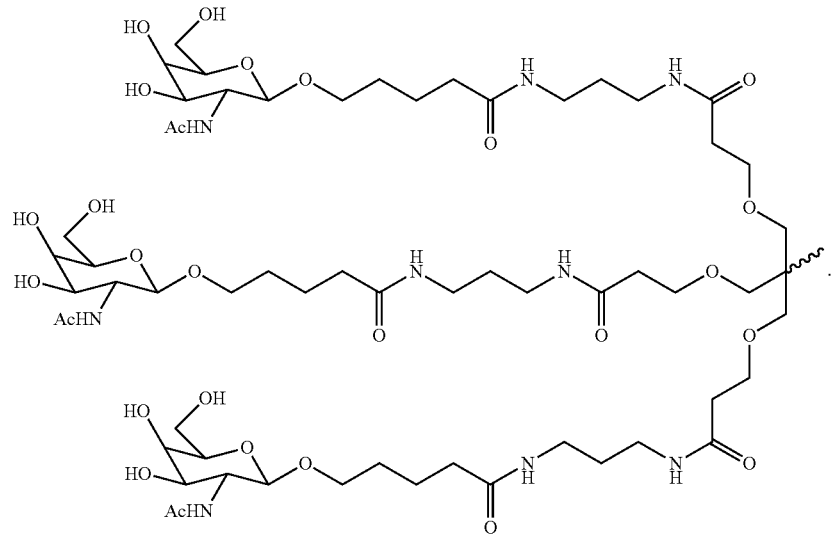 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

In one embodiment, the dsRNA agent is conjugated to the ligand as shown in the following schematic

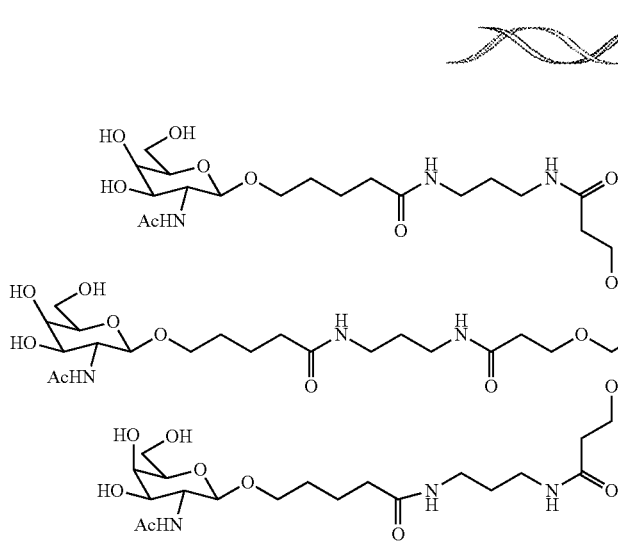
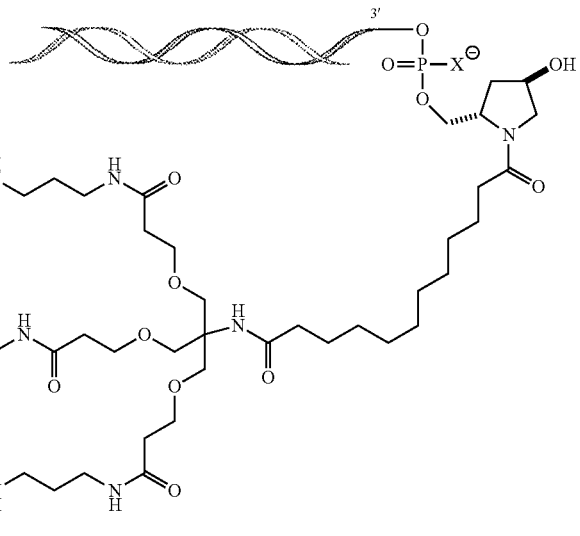

and, wherein X is O or S.

In one embodiment, the X is O.

In one embodiment, the dsRNA agent further comprises at least one phosphorothioate or methylphosphonate internucleotide linkage.

In one embodiment, the phosphorothioate or methylphosphonate internucleotide linkage is at the 3'-terminus of one strand, e.g., the antisense strand or the sense strand.

In another embodiment, the phosphorothioate or methylphosphonate internucleotide linkage is at the 5'-terminus of one strand, e.g., the antisense strand or the sense strand.

In one embodiment, the phosphorothioate or methylphosphonate internucleotide linkage is at both the 5'- and 3'-terminus of one strand. In one embodiment, the strand is the antisense strand.

In one embodiment, the base pair at the 1 position of the 5'-end of the antisense strand of the duplex is an AU base pair.

The present invention also provides cells containing any of the dsRNA agents of the invention and pharmaceutical compositions comprising any of the dsRNA agents of the invention.

The pharmaceutical composition of the invention may include dsRNA agent in an unbuffered solution, e.g., saline or water, or the pharmaceutical composition of the invention may include the dsRNA agent is in a buffer solution, e.g., a buffer solution comprising acetate, citrate, prolamine, carbonate, or phosphate or any combination thereof; or phosphate buffered saline (PBS).

In one aspect, the present invention provides a method of inhibiting expression of a solute carrier family 30 member 10 (SLC30A10) gene in a cell. The method includes contacting the cell with any of the dsRNA agents of the invention, or any of the pharmaceutical compositions of the invention, thereby inhibiting expression of the SLC30A10 gene in the cell.

In another aspect, the present invention provides a method of inhibiting expression of a solute carrier family 39 member 8 (SLC39A8) gene in a cell. The method includes contacting the cell with any of the dsRNA agents of the invention, or any of the pharmaceutical compositions of the invention, thereby inhibiting expression of the SLC39A8 gene in the cell.

In one embodiment, the cell is within a subject, e.g., a human subject, e.g., a subject having a solute carrier family member-associated disorder, e.g., an SLC30A10-associated disorder or an SLC39A8-associated disorder.

In one embodiment, the solute carrier family member-associated disorder, e.g., the SLC30A10-associated disorder or the SLC39A8-associated disorder, is a hypermanganesemia. In one embodiment, the hypermanganesemia is the result of environmental exposure to excess Mn, and the hypermanganesemia, e.g., manganism. In one embodiment, the subject having manganism does not have an inherited hypermanganesemia.

In another embodiment, the hypermanganesemia is an inherited hypermanganesemia, e.g., hypermanganesemia with dystonia-1.

In one embodiment, contacting the cell with the dsRNA agent inhibits the expression of a solute carrier family member, e.g., SLC30A10 or SLC39A8, by at least 50%, 60%, 70%, 80%, 90%, or 95%.

In one embodiment, inhibiting expression of the solute carrier family member, e.g., SLC30A10 or SLC39A8, causes a decrease in the protein levels in the subject's serum by at least 50%, 60%, 70%, 80%, 90%, or 95%.

In one aspect, the present invention provides a method of treating a subject having a disorder that would benefit from reduction in solute carrier family 30 member 10 (SLC30A10) expression. The method includes administering to the subject a therapeutically effective amount of any of the dsRNA agents of the invention, or any of the pharmaceutical compositions of the invention, thereby treating the subject having the disorder that would benefit from reduction in SLC30A10 expression.

In another aspect, the present invention provides a method of preventing at least one symptom in a subject having a disorder that would benefit from reduction in solute carrier family 30 member 10 (SLC30A10) expression. The method includes administering to the subject a prophylactically effective amount of any of the dsRNA agents of the invention, or any of the pharmaceutical compositions of the invention, thereby preventing at least one symptom in the subject having the disorder that would benefit from reduction in SLC30A10 expression.

In one aspect, the present invention provides a method of treating a subject having a disorder that would benefit from reduction in solute carrier family 39 member 8 (SLC39A8) expression. The method includes administering to the subject a therapeutically effective amount of any of the dsRNA agents of the invention, or any of the pharmaceutical compositions of the invention, thereby treating the subject having the disorder that would benefit from reduction in SLC39A8 expression.

In another aspect, the present invention provides a method of preventing at least one symptom in a subject having a disorder that would benefit from reduction in solute carrier family 39 member 8 (SLC39A8) expression. The method includes administering to the subject a prophylactically effective amount of any of the dsRNA agents of the invention, or any of the pharmaceutical compositions of the invention, thereby preventing at least one symptom in the subject having the disorder that would benefit from reduction in SLC39A8 expression.

In one embodiment, the disorder is a solute carrier family member-associated disorder, e.g., an SLC30A10-associated disorder or an SLC39A8-associated disorder.

In one embodiment, the solute carrier family member-associated disorder is a hypermanganesemia. In one embodiment, the hypermanganesemia is the result of environmental exposure to excess Mn, and the hypermanganesemia, e.g., manganism. In one embodiment, the subject having manganism does not have an inherited hypermanganesemia.

In another embodiment, the hypermanganesemia is an inherited hypermanganesemia, e.g., hypermanganesemia with dystonia-1.

In one embodiment, the subject is a human.

In one embodiment, the administration of the agent to the subject causes a decrease in serum manganese levels, an increase in urinary Mn levels, and/or a decrease in protein accumulation of a solute carrier family member, e.g., SLC30A10 or SLC39A8.

In one embodiment, the dsRNA agent is administered to the subject at a dose of about 0.01 mg/kg to about 50 mg/kg.

In one embodiment, the dsRNA agent is administered to the subject subcutaneously.

In one embodiment, the methods of the invention further include determining the level of a solute carrier family member, e.g., SLC30A10 or SLC39A8, in a sample from the subject.

In one embodiment, the level of a solute carrier family member, e.g., SLC30A10 or SLC39A8, in the subject sample is the protein level of the solute carrier family member, e.g., SLC30A10 or SLC39A8, in a blood or serum sample.

In one embodiment, the methods of the invention further include administering to the subject an additional therapeutic agent and/or treatment.

The present invention also provides kits comprising any of the dsRNA agents of the invention or any of the pharmaceutical compositions of the invention, and optionally, instructions for use.

DETAILED DESCRIPTION OF THE INVENTION

Figure 1:
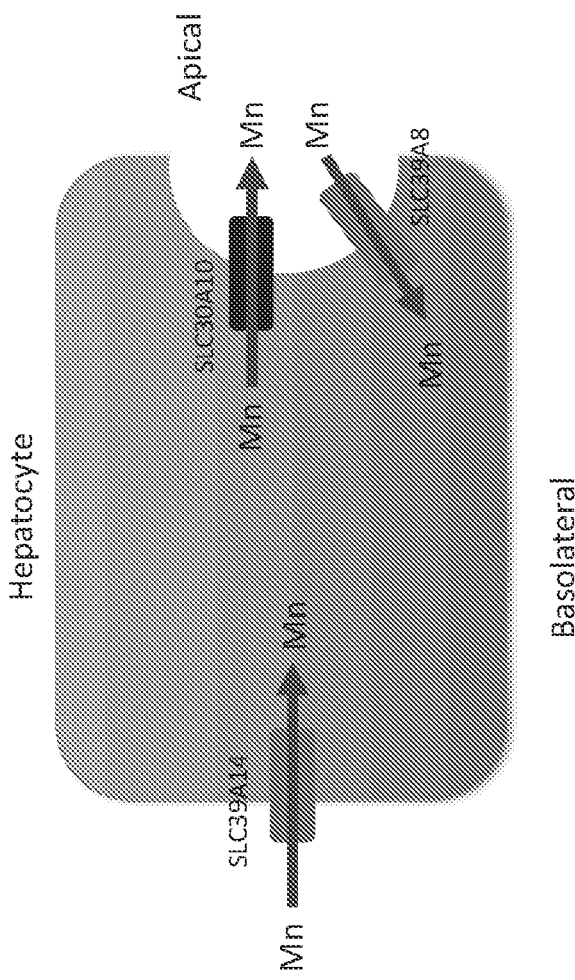
FIG. 1 schematically depicts the transporters involved in manganese (Mn) homeostasis.

The present invention provides iRNA compositions which effect the RNA-induced silencing complex (RISC)-mediated cleavage of RNA transcripts of a solute carrier family member gene, e.g., a solute carrier family 30 member 10 (SLC30A10) gene, or a solute carrier family 39 member 8 (SLC39A8) gene. The gene may be within a cell, e.g., a cell within a subject, such as a human. The use of these iRNAs enables the targeted degradation of mRNAs of the corresponding gene, e.g., an SLC30A10 gene or an SLC39A8 gene, in mammals.

The iRNAs of the invention have been designed to target the human solute carrier family member gene, e.g., SLC30A10 gene or SLC39A8 gene, including portions of the gene that are conserved in the orthologs of other mammalian species, e.g., SLC30A10 orthologs, or SLC39A8 orthologs. Without intending to be limited by theory, it is believed that a combination or sub-combination of the foregoing properties and the specific target sites or the specific modifications in these iRNAs confer to the iRNAs of the invention improved efficacy, stability, potency, durability, and safety.

Accordingly, the present invention provides methods for treating and preventing a solute carrier family member-associated disorder, e.g., an SLC30A10-associated disorder, or an SLC39A8-associated disorder, e.g., hypermanganesemia, such as manganism, using iRNA compositions which effect the RNA-induced silencing complex (RISC)-mediated cleavage of RNA transcripts of a solute carrier family member gene, e.g., an SLC30A10 gene or an SLC39A8 gene.

The iRNAs of the invention include an RNA strand (the antisense strand) having a region which is up to about 30 nucleotides or less in length, e.g., 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length, which region is substantially complementary to at least part of an mRNA transcript of a solute carrier family member gene, e.g., an SLC30A10 or an SLC39A8 gene.

In certain embodiments, one or both of the strands of the double stranded RNAi agents of the invention are up to 66 nucleotides in length, e.g., 36-66, 26-36, 25-36, 31-60, 22-43, 27-53 nucleotides in length, with a region of at least 19 contiguous nucleotides that is substantially complementary to at least a part of an mRNA transcript of a solute carrier family member gene, e.g., an SLC30A10 gene or an SLC39A8 gene. In some embodiments, such iRNA agents having longer length antisense strands preferably may include a second RNA strand (the sense strand) of 20-60 nucleotides in length wherein the sense and antisense strands form a duplex of 18-30 contiguous nucleotides.

The use of iRNAs of the invention enables the targeted degradation of mRNAs of the corresponding solute carrier family member gene (e.g., SLC30A10 gene or SLC39A8 gene) in mammals. Using in vitro and in vivo assays, the present inventors have demonstrated that iRNAs targeting a solute carrier family member gene, e.g., an SLC30A10 gene or an SLC39A8 gene, can potently mediate RNAi, resulting in significant inhibition of expression of a solute carrier family member gene, e.g., an SLC30A10 gene or an SLC39A8 gene. Thus, methods and compositions including these iRNAs are useful for treating a subject having a solute carrier family member-associated disorder, e.g., an SLC30A10-associated disorder or an SLC39A8-associated disorder, such as hypermanganesemia, e.g., manganism or hypermanganesemia with dystonia-1.

Accordingly, the present invention provides methods and combination therapies for treating a subject having a disorder that would benefit from inhibiting or reducing the expression of a solute carrier family member gene, e.g., an SLC30A10 gene or an SLC39A8 gene, e.g., a solute carrier family member-associated disorder, e.g., hypermanganesemia, such as manganism or hypermanganesemia with dystonia-1, using iRNA compositions which effect the RNA-induced silencing complex (RISC)-mediated cleavage of RNA transcripts of a solute carrier family member gene, e.g., an SLC30A10 gene or an SLC39A8 gene.

The present invention also provides methods for preventing at least one symptom in a subject having a disorder that would benefit from inhibiting or reducing the expression of a solute carrier family member, e.g., SLC30A10 or SLC39A8, such as a subject having a solute carrier family member-associated disorder, e.g., hypermanganesemia, such as manganism or hypermanganesemia with dystonia-1.

For example, in a subject having hypermanganesemia, such as manganism or hypermanganesemia with dystonia-1, the methods of the present invention may prevent at least one symptom in the subject including, e.g., elevated whole-blood manganese concentrations, elevated hemoglobin concentrations, elevated erythropoietin levels, elevated liver transaminases, hyperirritability, violent acts, hallucinations, disturbances of libido, anorexia, apathy, hypersomnolence, headaches psychosis, speech abnormalities, masklike facies, bradykinesia, micrographia, retropulsion and propulsion, fine or coarse tremor of the hands, and gross rhythmical movements of the trunk and head, liver fibrosis, cirrhosis, hepatomegaly, and unconjugated hyperbilirubinemia, polycythemia, manganese accumulation in the basal ganglia, parkinsonism, or on occasion spastic paraplegia.

The following detailed description discloses how to make and use compositions containing iRNAs to inhibit the expression of a solute carrier family member gene, e.g., an SLC30A10 gene or an SLC39A8 gene, as well as compositions, uses, and methods for treating subjects that would benefit from inhibition and/or reduction of the expression of a solute carrier family member gene, e.g., an SLC30A10 gene or an SLC39A8 gene, e.g., subjects susceptible to or diagnosed with a solute carrier family member-associated disorder, e.g., an SLC30A10-associated disorder or an SLC39A8-associated disorder.

I. Definitions

In order that the present invention may be more readily understood, certain terms are first defined. In addition, it should be noted that whenever a value or range of values of a parameter are recited, it is intended that values and ranges intermediate to the recited values are also intended to be part of this invention.

The articles "a" and "an" are used herein to refer to one or to more than one (i.e., to at least one) of the grammatical object of the article. By way of example, "an element" means one element or more than one element, e.g., a plurality of elements.

The term "including" is used herein to mean, and is used interchangeably with, the phrase "including but not limited to".

The term "or" is used herein to mean, and is used interchangeably with, the term "and/or," unless context clearly indicates otherwise. For example, "sense strand or antisense strand" is understood as "sense strand or antisense strand or sense strand and antisense strand."

The term "about" is used herein to mean within the typical ranges of tolerances in the art. For example, "about" can be understood as about 2 standard deviations from the mean. In certain embodiments, about means±10%. In certain embodiments, about means±5%. When about is present before a series of numbers or a range, it is understood that "about" can modify each of the numbers in the series or range.

The term "at least" prior to a number or series of numbers is understood to include the number adjacent to the term "at least", and all subsequent numbers or integers that could logically be included, as clear from context. For example, the number of nucleotides in a nucleic acid molecule must be an integer. For example, "at least 19 nucleotides of a 21 nucleotide nucleic acid molecule" means that 19, 20, or 21 nucleotides have the indicated property. When at least is present before a series of numbers or a range, it is understood that "at least" can modify each of the numbers in the series or range.

As used herein, "no more than" or "less than" is understood as the value adjacent to the phrase and logical lower values or integers, as logical from context, to zero. For example, a duplex with an overhang of "no more than 2 nucleotides" has a 2, 1, or 0 nucleotide overhang. When "no more than" is present before a series of numbers or a range, it is understood that "no more than" can modify each of the numbers in the series or range. As used herein, ranges include both the upper and lower limit.

In the event of a conflict between a sequence and its indicated site on a transcript or other sequence, the nucleotide sequence recited in the specification takes precedence.

As used herein, the term "solute carrier family 30 member 10," used interchangeably with the term "SLC30A10," refers to the well-known gene and polypeptide, also known in the art as manganese Transporter SLC30A10, Zinc Transporter 10, Zinc Transporter 8, ZnT-10, ZNT10, ZNT8, HMNDYT1, HMDPC, and ZRC1. The term "SLC30A10" includes human SLC30A10, the amino acid and nucleotide sequence of which may be found in, for example, GenBank Accession No. NM_018713.2 (SEQ ID NO: 1); mouse SLC30A10, the amino acid and nucleotide sequence of which may be found in, for example, GenBank Accession No. NM_001033286.2 (SEQ ID NO:2); and rat SLC30A10, the amino acid and nucleotide sequence of which may be found in, for example, GenBank Accession No. NM_001105985.1 (SEQ ID NO:3).

The term "SLC30A10" also includes *Macaca mulatta* SLC30A10, the amino acid and nucleotide sequence of which may be found in, for example, GenBank Accession No. XM_001103570.3 (SEQ ID NO:4) nad *Macaca fascicularis* SLC30A10, the amino acid and nucleotide sequence of which may be found in, for example, GenBank Accession No. XM_015450171.1 (SEQ ID NO:5).

Additional examples of SLC30A10 mRNA sequences are readily available using, e.g., GenBank, UniProt, OMIM, and the *Macaca* genome project web site.

Exemplary SLC30A10 nucleotide sequences may also be found in SEQ ID NOs:1-10. SEQ ID NOs:6-10 are the reverse complement sequences of SEQ ID NOs:1-5, respectively.

Further information on SLC30A10 is provided, for example in the NCBI Gene database at https://www.ncbi.nlm.nih.gov/gene/55532.

The entire contents of each of the foregoing GenBank Accession numbers and the Gene database numbers are incorporated herein by reference as of the date of filing this application.

The terms "solute carrier family 30 member 10" and "SLC30A10," as used herein, also refer to naturally occurring DNA sequence variations of the SLC30A10 gene. Numerous sequence variations within the SLC30A10 gene have been identified and may be found at, for example, NCBI dbSNP and UniProt (see, e.g., https://www.ncbi.nlm.nih.gov/snp/?LinkName=gene_snp&from_uid=55532, the entire contents of which are incorporated herein by reference as of the date of filing this application.

As used herein, the term "solute carrier family 39 member 8," used interchangeably with the term "SLC39A8," refers to the well-known gene and polypeptide, also known in the art as Zinc transporter ZIP 8, ZIP8, CDG2N, PP3105, BIGM103, LZT-Hs6, BCG-Induced Integral Membrane Protein In Monocyte Clone 103 Protein, LIV-1 Subfamily Of ZIP Zinc Transporter 6, Zrt- And Irt-Like Protein 8, or BCG Induced Integral Membrane Protein BIGM103. The term "SLC39A8" includes human SLC39A8, the amino acid and nucleotide sequence of which may be found in, for example, GenBank Accession No. NM_001135146.2 (GI: 1519242726; SEQ ID NO: 11); mouse SLC39A8, the amino acid and nucleotide sequence of which may be found in, for example, GenBank Accession No. NM_001135149.1 (GI: 205830409; SEQ ID NO: 12); and rat SLC39A8, the amino acid and nucleotide sequence of which may be found in, for example, GenBank Accession No. NM_001011952.1 (GI: 58865481; SEQ ID NO:13).

The term "SLC39A8" also includes *Macaca fascicularis* SLC39A8, the amino acid and nucleotide sequence of which may be found in, for example, GenBank Accession No. XM_005555550.1 (GI:544433835; SEQ ID NO:14).

Additional examples of SLC39A8 mRNA sequences are readily available using, e.g., GenBank, UniProt, OMIM, and the *Macaca* genome project web site.

Exemplary SLC39A8 nucleotide sequences may also be found in SEQ ID NOs:11-18. SEQ ID NOs:15-18 are the reverse complement sequences of SEQ ID NOs:11-14, respectively.

Further information on SLC39A8 is provided, for example in the NCBI Gene database at https://www.ncbi.nlm.nih.gov/gene/64116.

The entire contents of each of the foregoing GenBank Accession numbers and the Gene database numbers are incorporated herein by reference as of the date of filing this application.

The terms "solute carrier family 39 member 8" and "SLC39A8," as used herein, also refer to naturally occurring DNA sequence variations of the SLC39A8 gene. Numerous sequence variations within the SLC39A8 gene have been identified and may be found at, for example, NCBI dbSNP and UniProt (see, e.g., https://www.ncbi.nlm.nih.gov/SNP/snp_ref.cgi?locusId=64116, the entire contents of which are incorporated herein by reference as of the date of filing this application.

As used herein, "target sequence" refers to a contiguous portion of the nucleotide sequence of an mRNA molecule formed during the transcription of a solute carrier family member gene, e.g., an SLC30A10 gene or an SLC39A8 gene, including mRNA that is a product of RNA processing of a primary transcription product. The target portion of the sequence will be at least long enough to serve as a substrate for iRNA-directed cleavage at or near that portion of the nucleotide sequence of an mRNA molecule formed during the transcription of a solute carrier family member gene, e.g., an SLC30A10 gene or an SLC39A8 gene. In one embodiment, the target sequence is within the protein coding region of SLC30A10. In another embodiment, the target sequence is within the protein coding region of SLC39A8.

The target sequence may be from about 19-36 nucleotides in length, e.g., preferably about 19-30 nucleotides in length. For example, the target sequence can be about 19-30 nucleotides, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. Ranges and lengths intermediate to the above recited ranges and lengths are also contemplated to be part of the invention.

As used herein, the term "strand comprising a sequence" refers to an oligonucleotide comprising a chain of nucleotides that is described by the sequence referred to using the standard nucleotide nomenclature.

"G," "C," "A," "T," and "U" each generally stand for a nucleotide that contains guanine, cytosine, adenine, thymidine, and uracil as a base, respectively. However, it will be understood that the term "ribonucleotide" or "nucleotide" can also refer to a modified nucleotide, as further detailed below, or a surrogate replacement moiety (see, e.g., Table 1). The skilled person is well aware that guanine, cytosine, adenine, and uracil can be replaced by other moieties without substantially altering the base pairing properties of an oligonucleotide comprising a nucleotide bearing such replacement moiety. For example, without limitation, a nucleotide comprising inosine as its base can base pair with nucleotides containing adenine, cytosine, or uracil. Hence, nucleotides containing uracil, guanine, or adenine can be replaced in the nucleotide sequences of dsRNA featured in the invention by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods featured in the invention.

The terms "iRNA", "RNAi agent," "iRNA agent,", "RNA interference agent" as used interchangeably herein, refer to an agent that contains RNA as that term is defined herein, and which mediates the targeted cleavage of an RNA transcript via an RNA-induced silencing complex (RISC) pathway. iRNA directs the sequence-specific degradation of mRNA through a process known as RNA interference (RNAi). The iRNA modulates, e.g., inhibits, the expression of a solute carrier family member gene, e.g., an SLC30A10 gene or an SLC39A8 gene, in a cell, e.g., a cell within a subject, such as a mammalian subject.

In one embodiment, an RNAi agent of the invention includes a single stranded RNA that interacts with a target RNA sequence, e.g., a target mRNA sequence, to direct the cleavage of the target RNA. Without wishing to be bound by theory it is believed that long double stranded RNA introduced into cells is broken down into siRNA by a Type III endonuclease known as Dicer (Sharp et al. (2001) *Genes Dev.* 15:485). Dicer, a ribonuclease-III-like enzyme, processes the dsRNA into 19-23 base pair short interfering RNAs with characteristic two base 3' overhangs (Bernstein, et al., (2001) *Nature* 409:363). The siRNAs are then incorporated into an RNA-induced silencing complex (RISC) where one or more helicases unwind the siRNA duplex, enabling the complementary antisense strand to guide target recognition (Nykanen, et al., (2001) *Cell* 107:309). Upon binding to the appropriate target mRNA, one or more endonucleases within the RISC cleave the target to induce silencing (Elbashir, et al., (2001) *Genes Dev.* 15:188). Thus, in one aspect the invention relates to a single stranded RNA (siRNA) generated within a cell and which promotes the formation of a RISC complex to effect silencing of the target gene, i.e., a solute carrier family member gene, e.g., an SLC30A10 gene or an SLC39A8 gene. Accordingly, the term "siRNA" is also used herein to refer to an iRNA as described above.

In certain embodiments, the RNAi agent may be a single-stranded siRNA (ssRNAi) that is introduced into a cell or organism to inhibit a target mRNA. Single-stranded RNAi agents bind to the RISC endonuclease, Argonaute 2, which then cleaves the target mRNA. The single-stranded siRNAs are generally 15-30 nucleotides and are chemically modified. The design and testing of single-stranded siRNAs are described in U.S. Pat. No. 8,101,348 and in Lima et al., (2012) *Cell* 150:883-894, the entire contents of each of which are hereby incorporated herein by reference. Any of the antisense nucleotide sequences described herein may be used as a single-stranded siRNA as described herein or as chemically modified by the methods described in Lima et al., (2012) *Cell* 150:883-894.

In certain embodiments, an "iRNA" for use in the compositions, uses, and methods of the invention is a double stranded RNA and is referred to herein as a "double stranded RNA agent," "double stranded RNA (dsRNA) molecule," "dsRNA agent," or "dsRNA". The term "dsRNA", refers to a complex of ribonucleic acid molecules, having a duplex structure comprising two anti-parallel and substantially complementary nucleic acid strands, referred to as having "sense" and "antisense" orientations with respect to a target RNA, i.e., a solute carrier family member gene, e.g., an SLC30A10 gene or an SLC39A8 gene. In some embodiments of the invention, a double stranded RNA (dsRNA) triggers the degradation of a target RNA, e.g., an mRNA, through a post-transcriptional gene-silencing mechanism referred to herein as RNA interference or RNAi.

In general, the majority of nucleotides of each strand of a dsRNA molecule are ribonucleotides, but as described in detail herein, each or both strands can also include one or more non-ribonucleotides, e.g., a deoxyribonucleotide or a modified nucleotide. In addition, as used in this specification, an "iRNA" may include ribonucleotides with chemical modifications; an iRNA may include substantial modifications at multiple nucleotides. As used herein, the term "modified nucleotide" refers to a nucleotide having, independently, a modified sugar moiety, a modified internucleotide linkage, or modified nucleobase, or any combination thereof. Thus, the term modified nucleotide encompasses substitutions, additions or removal of, e.g., a functional group or atom, to internucleoside linkages, sugar moieties, or nucleobases. The modifications suitable for use in the agents of the invention include all types of modifications disclosed herein or known in the art. Any such modifications, as used in a siRNA type molecule, are encompassed by "iRNA" or "RNAi agent" for the purposes of this specification and claims.

The duplex region may be of any length that permits specific degradation of a desired target RNA through a RISC pathway, and may range from about 19 to 36 base pairs in length, e.g., about 19-30 base pairs in length, for example, about 9, 10, 11, 12, 13, 14, 15, 16, 17, 18, 19, 20, 21, 22, 23, 24, 25, 26, 27, 28, 29, 30, 31, 32, 33, 34, 35, or 36 base pairs in length, such as about 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. Ranges and lengths intermediate to the above recited ranges and lengths are also contemplated to be part of the invention.

The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5'-end of the respective other strand forming the duplex structure, the connecting RNA chain is referred to as a "hairpin loop." A hairpin loop can comprise at least one unpaired nucleotide. In some embodiments, the hairpin loop can comprise at least 2, 3, 4, 5, 6, 7, 8, 9, 10, 20, 23 or more unpaired nucleotides. In some embodiments, the hairpin loop can be 10 or fewer nucleotides. In some embodiments, the hairpin loop can be 8 or fewer unpaired nucleotides. In some embodiments, the hairpin loop can be 4-10 unpaired nucleotides. In some embodiments, the hairpin loop can be 4-8 nucleotides.

Where the two substantially complementary strands of a dsRNA are comprised by separate RNA molecules, those molecules need not be, but can be covalently connected. Where the two strands are connected covalently by means other than an uninterrupted chain of nucleotides between the 3'-end of one strand and the 5'-end of the respective other strand forming the duplex structure, the connecting structure is referred to as a "linker." The RNA strands may have the same or a different number of nucleotides. The maximum number of base pairs is the number of nucleotides in the shortest strand of the dsRNA minus any overhangs that are present in the duplex. In addition to the duplex structure, an RNAi may comprise one or more nucleotide overhangs.

In certain embodiments, an iRNA agent of the invention is a dsRNA, each strand of which comprises 19-23 nucleotides, that interacts with a target RNA sequence, e.g., a solute carrier family member gene, e.g., an SLC30A10 gene or an SLC39A8 gene, to direct cleavage of the target RNA.

In some embodiments, an iRNA of the invention is a dsRNA of 24-30 nucleotides that interacts with a target RNA sequence, e.g., a solute carrier family member mRNA sequence, e.g., SLC30A10 mRNA sequence or SLC39A8 mRNA sequence, to direct the cleavage of the target RNA.

As used herein, the term "nucleotide overhang" refers to at least one unpaired nucleotide that protrudes from the duplex structure of a double stranded iRNA. For example, when a 3-end of one strand of a dsRNA extends beyond the 5-end of the other strand, or vice versa, there is a nucleotide overhang. A dsRNA can comprise an overhang of at least one nucleotide; alternatively the overhang can comprise at least two nucleotides, at least three nucleotides, at least four nucleotides, at least five nucleotides or more. A nucleotide overhang can comprise or consist of a nucleotide/nucleoside analog, including a deoxynucleotide/nucleoside. The overhang(s) can be on the sense strand, the antisense strand, or any combination thereof. Furthermore, the nucleotide(s) of an overhang can be present on the 5-end, 3-end, or both ends of either an antisense or sense strand of a dsRNA.

In certain embodiments, the antisense strand of a dsRNA has a 1-10 nucleotides, e.g., a 1, 2, 3, 4, 5, 6, 7, 8, 9, or 10 nucleotide, overhang at the 3'-end or the 5'-end. In certain embodiments, the overhang on the sense strand or the antisense strand, or both, can include extended lengths longer than 10 nucleotides, e.g., 1-30 nucleotides, 2-30 nucleotides, 10-30 nucleotides, 10-25 nucleotides, 10-20 nucleotides, or 10-15 nucleotides in length. In certain embodiments, an extended overhang is on the sense strand of the duplex. In certain embodiments, an extended overhang is present on the 3' end of the sense strand of the duplex. In certain embodiments, an extended overhang is present on the 5' end of the sense strand of the duplex. In certain embodiments, an extended overhang is on the antisense strand of the duplex. In certain embodiments, an extended overhang is present on the 3' end of the antisense strand of the duplex. In certain embodiments, an extended overhang is present on the 5' end of the antisense strand of the duplex. In certain embodiments, one or more of the nucleotides in the extended overhang is replaced with a nucleoside thiophosphate. In certain embodiments, the overhang includes a self-complementary portion such that the overhang is capable of forming a hairpin structure that is stable under physiological conditions.

"Blunt" or "blunt end" means that there are no unpaired nucleotides at that end of the double stranded RNA agent, i.e., no nucleotide overhang. A "blunt ended" double stranded RNA agent is double stranded over its entire length, i.e., no nucleotide overhang at either end of the molecule. The RNAi agents of the invention include RNAi agents with no nucleotide overhang at one end (i.e., agents with one overhang and one blunt end) or with no nucleotide overhangs at either end. Most often such a molecule will be double-stranded over its entire length.

The term "antisense strand" or "guide strand" refers to the strand of an iRNA, e.g., a dsRNA, which includes a region that is substantially complementary to a target sequence, e.g., a solute carrier family member mRNA, e.g., SLC30A10 mRNA or SLC39A8 mRNA. As used herein, the term "region of complementarity" refers to the region on the antisense strand that is substantially complementary to a sequence, for example a target sequence, e.g., a solute carrier family member nucleotide sequence, e.g., SLC30A10 nucleotide sequence or SLC39A8 nucleotide sequence, as defined herein. Where the region of complementarity is not fully complementary to the target sequence, the mismatches can be in the internal or terminal regions of the molecule. Generally, the most tolerated mismatches are in the terminal regions, e.g., within 5, 4, or 3 nucleotides of the 5'- or 3'-end of the iRNA. In some embodiments, a double stranded RNA agent of the invention includes a nucleotide mismatch in the antisense strand. In some embodiments, the antisense strand double stranded RNA agent of the invention includes no more than 4 mismatches with the target mRNA, e.g., the antisense strand includes 4, 3, 2, 1, or 0 mismatches with the target mRNA. In some embodiments, the antisense strand double stranded RNA agent of the invention includes no more than 4 mismatches with the sense strand, e.g., the antisense strand includes 4, 3, 2, 1, or 0 mismatches with the sense strand. In some embodiments, a double stranded RNA agent of the invention includes a nucleotide mismatch in the sense strand. In some embodiments, the sense strand double stranded RNA agent of the invention includes no more than 4 mismatches with the antisense strand, e.g., the sense strand includes 4, 3, 2, 1, or 0 mismatches with the antisense strand. In some embodiments, the nucleotide mismatch is, for example, within 5, 4, 3 nucleotides from the 3'-end of the iRNA. In another embodiment, the nucleotide mismatch is, for example, in the 3'-terminal nucleotide of the iRNA. In some embodiments, the mismatch(s) is not in the seed region.

The term "sense strand" or "passenger strand" as used herein, refers to the strand of an iRNA that includes a region that is substantially complementary to a region of the antisense strand as that term is defined herein.

As used herein, "substantially all of the nucleotides are modified" are largely but not wholly modified and can include not more than 5, 4, 3, 2, or 1 unmodified nucleotides.

As used herein, the term "cleavage region" refers to a region that is located immediately adjacent to the cleavage site. The cleavage site is the site on the target at which cleavage occurs. In some embodiments, the cleavage region comprises three bases on either end of, and immediately adjacent to, the cleavage site. In some embodiments, the cleavage region comprises two bases on either end of, and immediately adjacent to, the cleavage site. In some embodiments, the cleavage site specifically occurs at the site bound by nucleotides 10 and 11 of the antisense strand, and the cleavage region comprises nucleotides 11, 12 and 13.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions can include: 400 mM NaCl, 40 mM PIPES pH 6.4, 1 mM EDTA, 50° C. or 70° C. for 12-16 hours followed by washing (see, e.g., "Molecular Cloning: A Laboratory Manual, Sambrook, et al. (1989) Cold Spring Harbor Laboratory Press). Other conditions, such as physiologically relevant conditions as can be encountered inside an organism, can apply. The skilled person will be able to determine the set of conditions most appropriate for a test of complementarity of two sequences in accordance with the ultimate application of the hybridized nucleotides.

Complementary sequences within an iRNA, e.g., within a dsRNA as described herein, include base-pairing of the oligonucleotide or polynucleotide comprising a first nucleotide sequence to an oligonucleotide or polynucleotide comprising a second nucleotide sequence over the entire length of one or both nucleotide sequences. Such sequences can be referred to as "fully complementary" with respect to each other herein. However, where a first sequence is referred to as "substantially complementary" with respect to a second sequence herein, the two sequences can be fully complementary, or they can form one or more, but generally not more than 5, 4, 3, or 2 mismatched base pairs upon hybridization for a duplex up to 30 base pairs, while retaining the ability to hybridize under the conditions most relevant to their ultimate application, e.g., inhibition of gene expression via a RISC pathway. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, can yet be referred to as "fully complementary" for the purposes described herein.

"Complementary" sequences, as used herein, can also include, or be formed entirely from, non-Watson-Crick base pairs or base pairs formed from non-natural and modified nucleotides, in so far as the above requirements with respect to their ability to hybridize are fulfilled. Such non-Watson-Crick base pairs include, but are not limited to, G:U Wobble or Hoogstein base pairing.

The terms "complementary," "fully complementary" and "substantially complementary" herein can be used with respect to the base matching between the sense strand and the antisense strand of a dsRNA, or between the antisense strand of a double stranded RNA agent and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of interest (e.g., an mRNA encoding a solute carrier family member gene, e.g., an SLC30A10 gene or an SLC39A8 gene). For example, a polynucleotide is complementary to at least a part of solute carrier family member mRNA, e.g., SLC30A10 mRNA or SLC39A8 mRNA, if the sequence is substantially complementary to a non-interrupted portion of an mRNA encoding a solute carrier family member gene, e.g., an SLC30A10 gene or an SLC39A8 gene.

Accordingly, in some embodiments, the antisense polynucleotides disclosed herein are fully complementary to the target solute carrier family member sequence, e.g., SLC30A10 sequence or SLC39A8 sequence. In other embodiments, the antisense polynucleotides disclosed herein are substantially complementary to the target solute carrier family member sequence, e.g., SLC30A10 sequence or SLC39A8 sequence, and comprise a contiguous nucleotide sequence which is at least 80% complementary over its entire length to the equivalent region of the nucleotide sequence of any one of SEQ ID NOs:1-5 and 11-14, or a fragment of any one of SEQ ID NOs:1-5 and 11-14, such as about 85%, about 90%, about 91%, about 92%, about 93%, about 94%, about 95%, about 96%, about 97%, about 98%, or about 99% complementary.

In some embodiments, the antisense polynucleotides disclosed herein are substantially complementary to the target solute carrier family member sequence, e.g., SLC30A10 sequence or SLC39A8 sequence, and comprise a contiguous nucleotide sequence which is at least about 80% complementary over its entire length to any one of the sense strand nucleotide sequences in any one of any one of Tables 2-9, or a fragment of any one of the sense strand nucleotide sequences in any one of Tables 2-9, such as about 85%, about 90%, about 91%, about 92%, about 93%, about 94%, about 95%, about 96%, about 97%, about 98%, about 99%, or 100% complementary.

In one embodiment, an RNAi agent of the disclosure includes a sense strand that is substantially complementary to an antisense polynucleotide which, in turn, is the same as a target solute carrier family member sequence, e.g., SLC30A10 sequence or SLC39A8 sequence, and wherein the sense strand polynucleotide comprises a contiguous nucleotide sequence which is at least about 80% complementary over its entire length to the equivalent region of the nucleotide sequence of SEQ ID NOs: 6-10 and 15-18, or a fragment of any one of SEQ ID NOs:6-10 and 15-18, such as about 85%, about 90%, about 91%, about 92%, about 93%, about 94%, about 95%, about 96%, about 97%, about 98%, about 99%, or 100% complementary.

In some embodiments, an iRNA of the invention includes a sense strand that is substantially complementary to an antisense polynucleotide which, in turn, is complementary to a target solute carrier family member sequence, e.g., SLC30A10 sequence or SLC39A8 sequence, and wherein the sense strand polynucleotide comprises a contiguous nucleotide sequence which is at least about 80% complementary over its entire length to any one of the antisense strand nucleotide sequences in any one of any one of Tables 2-9, or a fragment of any one of the antisense strand nucleotide sequences in any one of Tables 2-9, such as about 85%, about 90%, about 91%, about 92%, about 93%, about 94%, about 95%, about 96%, about 97%, about 98%, about 99%, or 100% complementary.

In general, an "iRNA" includes ribonucleotides with chemical modifications. Such modifications may include all types of modifications disclosed herein or known in the art. Any such modifications, as used in a dsRNA molecule, are encompassed by "iRNA" for the purposes of this specification and claims.

In an aspect of the invention, an agent for use in the methods and compositions of the invention is a single-stranded antisense oligonucleotide molecule that inhibits a target mRNA via an antisense inhibition mechanism. The single-stranded antisense oligonucleotide molecule is complementary to a sequence within the target mRNA. The single-stranded antisense oligonucleotides can inhibit translation in a stoichiometric manner by base pairing to the mRNA and physically obstructing the translation machinery, see Dias, N. et al., (2002) *Mol Cancer Ther* 1:347-355. The single-stranded antisense oligonucleotide molecule may be about 14 to about 30 nucleotides in length and have a sequence that is complementary to a target sequence. For example, the single-stranded antisense oligonucleotide molecule may comprise a sequence that is at least about 14, 15, 16, 17, 18, 19, 20, or more contiguous nucleotides from any one of the antisense sequences described herein.

The phrase "contacting a cell with an iRNA," such as a dsRNA, as used herein, includes contacting a cell by any possible means. Contacting a cell with an iRNA includes contacting a cell in vitro with the iRNA or contacting a cell in vivo with the iRNA. The contacting may be done directly or indirectly. Thus, for example, the iRNA may be put into physical contact with the cell by the individual performing the method, or alternatively, the iRNA may be put into a situation that will permit or cause it to subsequently come into contact with the cell.

Contacting a cell in vitro may be done, for example, by incubating the cell with the iRNA. Contacting a cell in vivo may be done, for example, by injecting the iRNA into or near the tissue where the cell is located, or by injecting the iRNA into another area, e.g., the bloodstream or the subcutaneous space, such that the agent will subsequently reach the tissue where the cell to be contacted is located. For example, the iRNA may contain or be coupled to a ligand, e.g., GalNAc, that directs the iRNA to a site of interest, e.g., the liver. Combinations of in vitro and in vivo methods of contacting are also possible. For example, a cell may also be contacted in vitro with an iRNA and subsequently transplanted into a subject.

In certain embodiments, contacting a cell with an iRNA includes "introducing" or "delivering the iRNA into the cell" by facilitating or effecting uptake or absorption into the cell. Absorption or uptake of an iRNA can occur through unaided diffusion or active cellular processes, or by auxiliary agents or devices. Introducing an iRNA into a cell may be in vitro or in vivo. For example, for in vivo introduction, iRNA can be injected into a tissue site or administered systemically. In vitro introduction into a cell includes methods known in the art such as electroporation and lipofection. Further approaches are described herein below or are known in the art.

The term "lipid nanoparticle" or "LNP" is a vesicle comprising a lipid layer encapsulating a pharmaceutically active molecule, such as a nucleic acid molecule, e.g., an iRNA or a plasmid from which an iRNA is transcribed. LNPs are described in, for example, U.S. Pat. Nos. 6,858,225, 6,815,432, 8,158,601, and 8,058,069, the entire contents of which are hereby incorporated herein by reference.

As used herein, a "subject" is an animal, such as a mammal, including a primate (such as a human, a non-human primate, e.g., a monkey, and a chimpanzee), a non-primate (such as a cow, a pig, a horse, a goat, a rabbit, a sheep, a hamster, a guinea pig, a cat, a dog, a rat, or a mouse), or a bird that expresses the target gene, either endogenously or heterologously. In an embodiment, the subject is a human, such as a human being treated or assessed for a disease or disorder that would benefit from reduction in expression of a solute carrier family member, e.g., SLC30A10 or SLC39A8; a human at risk for a disease or disorder that would benefit from reduction in expression of a solute carrier family member, e.g., SLC30A10 or SLC39A8; a human having a disease or disorder that would benefit from reduction in expression of a solute carrier family member, e.g., SLC30A10 or SLC39A8; or human being treated for a disease or disorder that would benefit from reduction in expression of a solute carrier family member, e.g., SLC30A10 or SLC39A8, as described herein. In some embodiments, the subject is a female human. In other embodiments, the subject is a male human. In one embodiment, the subject is an adult subject. In another embodiment, the subject is a pediatric subject.

As used herein, the terms "treating" or "treatment" refer to a beneficial or desired result, such as reducing at least one sign or symptom of a solute carrier family member-associated disorder, e.g., an SLC30A10-associated disorder or an SLC39A8-associated disorder, e.g., a hypermanganesemia, such as a subject manganism. Treatment also includes a reduction of one or more sign or symptoms associated with unwanted expression of a solute carrier family member, e.g., SLC30A10 or SLC39A8, e.g., hypermanganesemia; diminishing the extent of unwanted activation or stabilization of a solute carrier family member, e.g., SLC30A10 or SLC39A8; amelioration or palliation of unwanted activation or stabilization of a solute carrier family member, e.g., SLC30A10 or SLC39A8. "Treatment" can also mean prolonging survival as compared to expected survival in the absence of treatment.

The term "lower" in the context of the level of gene expression or protein production of a solute carrier family member, e.g., SLC30A10 or SLC39A8, in a subject, or a disease marker or symptom refers to a statistically significant decrease in such level. The decrease can be, for example, at least 50%, 55%, 60%, 65%, 70%, 75%, 80%, 85%, 90%, or 95%, or below the level of detection for the detection method in a relevant cell or tissue, e.g., a liver cell, or other subject sample, e.g., blood or serum derived therefrom, urine.

As used herein, "prevention" or "preventing," when used in reference to a disease or disorder, that would benefit from a reduction in gene expression or protein production of a solute carrier family member, e.g., SLC30A10 or SLC39A8, e.g., in a subject susceptible to an solute carrier family member-associated disorder due to, e.g., environmental exposure, aging, hormone changes, diet, and a sedentary lifestyle. The likelihood of developing, e.g., hypermanganesemia, is reduced, for example, when an individual having one or more risk factors for hypermanganesemia either fails to develop hypermanganesemia or develops hypermanganesemia with less severity relative to a population having the same risk factors and not receiving treatment as described herein. The failure to develop a solute carrier family member-associated disorder, e.g., hypermanganesemia, or a delay in the time to develop hypermanganesemia by months or years is considered effective prevention. Prevention may require administration of more than one dose if the iRNA agent.

As used herein, the term "solute carrier family member-associated disease" is a disease or disorder that would benefit from reduction in expression of a solute carrier family member, e.g., SLC30A10 or SLC39A8. Non-limiting examples of solute carrier family member-associated diseases include SLC30A10-associated diseases or SLC39A8-associated diseases, e.g., hypermanganesemia.

As used herein, a "hypermanganesemia" is a disorder characterized by whole blood manganese concentrations that equal to or greater than about 2000 nmol/L (the normal whole blood Mn concentration is lower than about 320 nmol/L). Hypermagenesemia is associated neurologic disorders such as dystonia/parkinsonism, and other disorders such as polycythemia and hepatomegaly with variable fibrosis and/or cirrhosis. Symptoms of hypermanganese also include weakness, confusion, decreased breathing rate, and decreased reflexes. Complications may include low blood pressure and cardiac arrest.

In some embodiments, the hypermanganesemia is the result of environmental exposure to excess Mn. In some embodiments, the hypermanganesemia which is a result of environmental exposure is "manganism" (also known as "manganese poisoning," "manganese toxicity," "manganese madness," "manganese-induced parkinsonism," and "manganese intoxication") which is Mn toxicity due to result of environmental (e.g., occupational) exposure to excess Mn, such as Mn intoxication that may occur in miners, welders, subjects living or working near ferro-alley factories, subjects drinking contaminated water, subjects receiving total perenteral nutrition, or those with hepatocerebral degeneration. In some embodiments, the subject having manganism does not have an inherited hypermanganesemia.

In other embodiments, the hypermanganesemia is an inherited disorder. In one embodiment, the inherited disorder is hypermanganesemia with dystonia-1 and the subject carries a mutation in an SLC30A10 gene (see, e.g., OMIM entry 611146 (the entire contents of which are incorporated herein by reference) describing allelic variants of SLC30A10 which have been identified in subjects having hypermanganesemia with dystonia-1). In one embodiment, the inherited disorder is hypermanganesemia with dystonia-2 and the subject carries a mutation in an SLC39A14 gene (see, e.g., OMIM entry 608736 (the entire contents of which are incorporated herein by reference) describing allelic variants of SLC39A14 which have been identified in subjects having hypermanganesemia with dystonia-2).

In hypermanganesemia with dystonia-1, also known as hypermanganesemia with dystonia, polycythemia, and cirrhosis (HMDPC), manganese accumulates in the blood, brain, and liver. Signs and symptoms of the condition can begin in childhood (early-onset), typically between ages 2 and 15, or in adulthood (adult-onset). Most children with the early-onset form of hypermanganesemia with dystonia-1 experience dystonia in the arms and legs, which often leads to a characteristic high-stepping walk described as a "cock-walk gait." Other neurological symptoms in affected children include involuntary trembling (tremor), unusually slow movement (bradykinesia), and slurred speech (dysarthria). The adult-onset form of hypermanganesemia with dystonia-1 is characterized by a pattern of movement abnormalities known as parkinsonism, which includes bradykinesia, tremor, muscle rigidity, and an inability to hold the body upright and balanced (postural instability). Individuals with hypermanganesemia with dystonia-1 have an increased number of red blood cells (polycythemia) and low levels of iron stored in the body. Additional features of hypermanganesemia with dystonia-1 can include an enlarged liver (hepatomegaly) due to manganese accumulation in the organ, scarring (fibrosis) in the liver, and irreversible liver disease (cirrhosis).

In hypermanganesemia with dystonia-2, manganese accumulates in the blood and brain. Signs and symptoms of this type of the disorder usually begin between ages 6 months and 3 years. Development of motor skills, such as sitting and walking, may be delayed, or if already learned, they may be lost. Dystonia can affect any part of the body and worsens over time. By late childhood, the sustained muscle contractions often result in joints that are permanently bent (contractures) and an inability to walk unassisted. Some affected individuals have an abnormal curvature of the spine (scoliosis). People with hypermanganesemia with dystonia 2 can have other neurological problems similar to those in HMDPC, such as tremor, bradykinesia, parkinsonism, and dysarthria. Unlike in hypermanganesemia with dystonia-1, individuals with hypermanganesemia with dystonia-2 do not develop polycythemia or liver problems.

A "therapeutically-effective amount" or "prophylactically effective amount" also includes an amount of an RNAi agent that produces some desired effect at a reasonable benefit/risk ratio applicable to any treatment. The iRNA employed in the methods of the present invention may be administered in a sufficient amount to produce a reasonable benefit/risk ratio applicable to such treatment.

The phrase "pharmaceutically acceptable" is employed herein to refer to those compounds, materials, compositions, or dosage forms which are, within the scope of sound medical judgment, suitable for use in contact with the tissues of human subjects and animal subjects without excessive toxicity, irritation, allergic response, or other problem or complication, commensurate with a reasonable benefit/risk ratio.

The phrase "pharmaceutically-acceptable carrier" as used herein means a pharmaceutically-acceptable material, composition, or vehicle, such as a liquid or solid filler, diluent, excipient, manufacturing aid (e.g., lubricant, talc magnesium, calcium or zinc stearate, or steric acid), or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the subject being treated. Such carriers are known in the art. Pharmaceutically acceptable carriers include carriers for administration by injection.

The term "sample," as used herein, includes a collection of similar fluids, cells, or tissues isolated from a subject, as well as fluids, cells, or tissues present within a subject. Examples of biological fluids include blood, serum and serosal fluids, plasma, cerebrospinal fluid, ocular fluids, lymph, urine, saliva, and the like. Tissue samples may include samples from tissues, organs, or localized regions. For example, samples may be derived from particular organs, parts of organs, or fluids or cells within those organs. In certain embodiments, samples may be derived from the liver (e.g., whole liver or certain segments of liver or certain types of cells in the liver, such as, e.g., hepatocytes). In some embodiments, a "sample derived from a subject" refers to urine obtained from the subject. A "sample derived from a subject" can refer to blood or blood derived serum or plasma from the subject.

II. iRNAs of the Invention

The present invention provides iRNAs which inhibit the expression of a solute carrier family member gene, e.g., an SLC30A10 gene or an SLC39A8 gene. In preferred embodiments, the iRNA includes double stranded ribonucleic acid (dsRNA) molecules for inhibiting the expression of a solute carrier family member gene, e.g., an SLC30A10 gene or an SLC39A8 gene, in a cell, such as a cell within a subject, e.g., a mammal, such as a human susceptible to developing a solute carrier family member-associated disorder, e.g., an SLC30A10-associated disorder or an SLC39A8-associated disorder, e.g., hypermanganesemia. The dsRNAi agent includes an antisense strand having a region of complementarity which is complementary to at least a part of an mRNA formed in the expression of a solute carrier family member gene, e.g., an SLC30A10 gene or an SLC39A8 gene. The region of complementarity is about 19-30 nucleotides in length (e.g., about 30, 29, 28, 27, 26, 25, 24, 23, 22, 21, 20, or 19 nucleotides in length). Upon contact with a cell expressing the solute carrier family member gene, e.g., SLC30A10 or SLC39A8, the iRNA inhibits the expression of the gene (e.g., a human, a primate, a non-primate, or a rat SLC30A10 or SLC39A8 gene) by at least about 50% as assayed by, for example, a PCR or branched DNA (bDNA)-based method, or by a protein-based method, such as by immunofluorescence analysis, using, for example, western blotting or flow cytometric techniques. In preferred embodiments, inhibition of expression is determined by the qPCR method with the siRNA at a 10 nM concentration in an appropriate organism cell line provided therein. In preferred embodiments, inhibition of expression in vivo is determined by knockdown of the human gene in a rodent expressing the human gene, e.g., a mouse or an AAV-infected mouse expressing the human target gene, e.g., when administered a single dose, e.g., at 3 mg/kg at the nadir of RNA expression. RNA expression in liver is determined using the PCR methods provided in Example 2.

A dsRNA includes two RNA strands that are complementary and hybridize to form a duplex structure under conditions in which the dsRNA will be used. One strand of a dsRNA (the antisense strand) includes a region of complementarity that is substantially complementary, and generally fully complementary, to a target sequence. The target sequence can be derived from the sequence of an mRNA formed during the expression of a solute carrier family member gene, e.g., an SLC30A10 gene or an SLC39A8 gene. The other strand (the sense strand) includes a region that is complementary to the antisense strand, such that the two strands hybridize and form a duplex structure when combined under suitable conditions. As described elsewhere herein and as known in the art, the complementary sequences of a dsRNA can also be contained as self-complementary regions of a single nucleic acid molecule, as opposed to being on separate oligonucleotides.

Generally, the duplex structure is 19 to 30 base pairs in length. Similarly, the region of complementarity to the target sequence is 19 to 30 nucleotides in length.

In some embodiments, the dsRNA is about 19 to about 23 nucleotides in length, or about 25 to about 30 nucleotides in length. In general, the dsRNA is long enough to serve as a substrate for the Dicer enzyme. For example, it is well-known in the art that dsRNAs longer than about 21-23 nucleotides in length may serve as substrates for Dicer. As the ordinarily skilled person will also recognize, the region of an RNA targeted for cleavage will most often be part of a larger RNA molecule, often an mRNA molecule. Where relevant, a "part" of an mRNA target is a contiguous sequence of an mRNA target of sufficient length to allow it to be a substrate for RNAi-directed cleavage (i.e., cleavage through a RISC pathway).

One of skill in the art will also recognize that the duplex region is a primary functional portion of a dsRNA, e.g., a duplex region of about 19 to about 30 base pairs, e.g., about 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs. Thus, in one embodiment, to the extent that it becomes processed to a functional duplex, of e.g., 15-30 base pairs, that targets a desired RNA for cleavage, an RNA molecule or complex of RNA molecules having a duplex region greater than 30 base pairs is a dsRNA. Thus, an ordinarily skilled artisan will recognize that in one embodiment, a miRNA is a dsRNA. In another embodiment, a dsRNA is not a naturally occurring miRNA. In another embodiment, an iRNA agent useful to target expression of a solute carrier family member gene, e.g., an SLC30A10 gene or an SLC39A8 gene, is not generated in the target cell by cleavage of a larger dsRNA.

A dsRNA as described herein can further include one or more single-stranded nucleotide overhangs e.g., 1-4, 2-4, 1-3, 2-3, 1, 2, 3, or 4 nucleotides. dsRNAs having at least one nucleotide overhang can have superior inhibitory properties relative to their blunt-ended counterparts. A nucleotide overhang can comprise or consist of a nucleotide/nucleoside analog, including a deoxynucleotide/nucleoside. The overhang(s) can be on the sense strand, the antisense strand, or any combination thereof. Furthermore, the nucleotide(s) of an overhang can be present on the 5-end, 3'-end, or both ends of an antisense or sense strand of a dsRNA.

A dsRNA can be synthesized by standard methods known in the art. Double stranded RNAi compounds of the invention may be prepared using a two-step procedure. First, the individual strands of the double stranded RNA molecule are prepared separately. Then, the component strands are annealed. The individual strands of the siRNA compound can be prepared using solution-phase or solid-phase organic synthesis or both. Organic synthesis offers the advantage that the oligonucleotide strands comprising unnatural or modified nucleotides can be easily prepared. Similarly, single-stranded oligonucleotides of the invention can be prepared using solution-phase or solid-phase organic synthesis or both.

In an aspect, a dsRNA of the invention includes at least two nucleotide sequences, a sense sequence and an antisense sequence. The sense strand is selected from the group of sequences provided in any one of Tables 2-9, and the corresponding antisense strand of the sense strand is selected from the group of sequences of any one of Tables 2-9. In this aspect, one of the two sequences is complementary to the other of the two sequences, with one of the sequences being substantially complementary to a sequence of an mRNA generated in the expression of a solute carrier family member gene, e.g., an SLC30A10 gene or an SLC39A8 gene. As such, in this aspect, a dsRNA will include two oligonucleotides, where one oligonucleotide is described as the sense strand in any one of Tables 2-9, and the second oligonucleotide is described as the corresponding antisense strand of the sense strand in any one of Tables 2-9. In one embodiment, a dsRNA of the invention comprises a sense strand an antisense strand of a duplex selected from the group consisting of AD-858799, AD-858788, AD-858795, AD-858797, AD-858794, and AD-859008.1. In certain embodiments, the substantially complementary sequences of the dsRNA are contained on separate oligonucleotides. In other embodiments, the substantially complementary sequences of the dsRNA are contained on a single oligonucleotide. It will be understood that, although the sequences in Tables 2-9 are not described as modified or conjugated sequences, the RNA of the iRNA of the invention e.g., a dsRNA of the invention, may comprise any one of the sequences set forth in any one of Tables 2-9 that is un-modified, un-conjugated, or modified or conjugated differently than described therein. In other words, the invention encompasses dsRNA of Tables 2-9 which are un-modified, un-conjugated, modified, or conjugated, as described herein.

The skilled person is well aware that dsRNAs having a duplex structure of about 20 to 23 base pairs, e.g., 21, base pairs have been hailed as particularly effective in inducing RNA interference (Elbashir et al., *EMBO* 2001, 20:6877-6888). However, others have found that shorter or longer RNA duplex structures can also be effective (Chu and Rana (2007) *RNA* 14:1714-1719; Kim et al. (2005) *Nat Biotech* 23:222-226). In the embodiments described above, by virtue of the nature of the oligonucleotide sequences provided in any one of Tables 2-9, dsRNAs described herein can include at least one strand of a length of minimally 21 nucleotides. It can be reasonably expected that shorter duplexes having any one of the sequences in any one of Tables 2-9 minus only a few nucleotides on one or both ends can be similarly effective as compared to the dsRNAs described above. Hence, dsRNAs having a sequence of at least 19, 20, or more contiguous nucleotides derived from any one of the sequences of any one of Tables 2-9, and differing in their ability to inhibit the expression of a solute carrier family member gene, e.g., an SLC30A10 gene or an SLC39A8 gene, by not more than about 5, 10, 15, 20, 25, or 30% inhibition from a dsRNA comprising the full sequence, are contemplated to be within the scope of the present invention.

In addition, the RNAs provided in Tables 2-9 identify a site(s) in a solute carrier family member transcript, e.g., SLC30A10A transcript or SLC39A8 transcript, that is susceptible to RISC-mediated cleavage. As such, the present invention further features iRNAs that target within one of these sites. As used herein, an iRNA is said to target within a particular site of an RNA transcript if the iRNA promotes cleavage of the transcript anywhere within that particular site. Such an iRNA will generally include at least about 19 contiguous nucleotides from any one of the sequences provided in any one of Tables 2-9 coupled to additional nucleotide sequences taken from the region contiguous to the selected sequence in a solute carrier family member gene, e.g., an SLC30A10 gene or an SLC39A8 gene. In some embodiments, a dsRNA of the invention targets nucleotides 713-735, 719-741, 720-742, 722-744, 724-746, or 1013-1035 of SEQ ID NO: 12.

III. Modified iRNAs of the Invention

In certain embodiments, the RNA of the iRNA of the invention e.g., a dsRNA, is un-modified, and does not comprise, e.g., chemical modifications or conjugations known in the art and described herein. In other embodiments, the RNA of an iRNA of the invention, e.g., a dsRNA, is chemically modified to enhance stability or other beneficial characteristics. In certain embodiments of the invention, substantially all of the nucleotides of an iRNA of the invention are modified. In other embodiments of the invention, all of the nucleotides of an iRNA or substantially all of the nucleotides of an iRNA are modified, i.e., not more than 5, 4, 3, 2, or 1 unmodified nucleotides are present in a strand of the iRNA.

The nucleic acids featured in the invention can be synthesized or modified by methods well established in the art, such as those described in "Current protocols in nucleic acid chemistry," Beaucage, S. L. et al. (Edrs.), John Wiley & Sons, Inc., New York, NY, USA, which is hereby incorporated herein by reference. Modifications include, for example, end modifications, e.g., 5'-end modifications (phosphorylation, conjugation, inverted linkages) or 3'-end modifications (conjugation, DNA nucleotides, inverted linkages, etc.); base modifications, e.g., replacement with stabilizing bases, destabilizing bases, or bases that base pair with an expanded repertoire of partners, removal of bases (abasic nucleotides), or conjugated bases; sugar modifications (e.g., at the 2'-position or 4'-position) or replacement of the sugar; or backbone modifications, including modification or replacement of the phosphodiester linkages. Specific examples of iRNA compounds useful in the embodiments described herein include, but are not limited to RNAs containing modified backbones or no natural internucleoside linkages. RNAs having modified backbones include, among others, those that do not have a phosphorus atom in the backbone. For the purposes of this specification, and as sometimes referenced in the art, modified RNAs that do not have a phosphorus atom in their internucleoside backbone can also be considered to be oligonucleosides. In some embodiments, a modified iRNA will have a phosphorus atom in its internucleoside backbone.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5'-linked analogs of these, and those having inverted polarity wherein the adjacent pairs of nucleoside units are linked 3'-5' to 5'-3' or 2'-5' to 5'-2'. Various salts, mixed salts and free acid forms are also included.

In some embodiments of the invention, the dsRNA agents of the invention are in a free acid form. In other embodiments of the invention, the dsRNA agents of the invention are in a salt form. In one embodiment, the dsRNA agents of the invention are in a sodium salt form. In certain embodiments, when the dsRNA agents of the invention are in the sodium salt form, sodium ions are present in the agent as counterions for substantially all of the phosphodiester and/or phosphorothioate groups present in the agent. Agents in which substantially all of the phosphodiester and/or phosphorothioate linkages have a sodium counterion include not more than 5, 4, 3, 2, or 1 phosphodiester and/or phosphorothioate linkages without a sodium counterion. In some embodiments, when the dsRNA agents of the invention are in the sodium salt form, sodium ions are present in the agent as counterions for all of the phosphodiester and/or phosphorothiotate groups present in the agent.

Representative U.S. patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; 5,625,050; 6,028,188; 6,124,445; 6,160,109; 6,169,170; 6,172,209; 6,239,265; 6,277,603; 6,326,199; 6,346,614; 6,444,423; 6,531,590; 6,534,639; 6,608,035; 6,683,167; 6,858,715; 6,867,294; 6,878,805; 7,015,315; 7,041,816; 7,273,933; 7,321,029; and RE39464, the entire contents of each of which are hereby incorporated herein by reference.

Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S, and $CH_2$ component parts.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and 5,677,439, the entire contents of each of which are hereby incorporated herein by reference.

Suitable RNA mimetics are contemplated for use in iRNAs provided herein, in which both the sugar and the internucleoside linkage, i.e., the backbone, of the nucleotide units are replaced with novel groups. The base units are maintained for hybridization with an appropriate nucleic acid target compound. One such oligomeric compound in which an RNA mimetic that has been shown to have excellent hybridization properties is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone. Representative US patents that teach the preparation of PNA compounds include, but are not limited to, U.S. Pat. Nos. 5,539,082; 5,714,331; and 5,719,262, the entire contents of each of which are hereby incorporated herein by reference. Additional PNA compounds suitable for use in the iRNAs of the invention are described in, for example, in Nielsen et al., *Science*, 1991, 254, 1497-1500.

Some embodiments featured in the invention include RNAs with phosphorothioate backbones and oligonucleosides with heteroatom backbones, and in particular —$CH_2$—NH—$CH_2$—, —$CH_2$—N($CH_3$)—O—$CH_2$-[known as a methylene (methylimino) or MMI backbone], —$CH_2$—O—N($CH_3$)—$CH_2$—, —$CH_2$—N($CH_3$)—N($CH_3$)—$CH_2$— and —N($CH_3$)—$CH_2$—$CH_2$-[wherein the native phosphodiester backbone is represented as —O—P—O—$CH_2$—] of the above-referenced U.S. Pat. No. 5,489,677, and the amide backbones of the above-referenced U.S. Pat. No. 5,602,240. In some embodiments, the RNAs featured herein have morpholino backbone structures of the above-referenced U.S. Pat. No. 5,034,506.

Modified RNAs can also contain one or more substituted sugar moieties. The iRNAs, e.g., dsRNAs, featured herein can include one of the following at the 2'-position: OH; F; O-, S-, or N-alkyl; O-, S-, or N-alkenyl; O-, S- or N-alkynyl; or O-alkyl-O-alkyl, wherein the alkyl, alkenyl and alkynyl can be substituted or unsubstituted $C_1$ to $C_{10}$ alkyl or $C_2$ to $C_{10}$ alkenyl and alkynyl. Exemplary suitable modifications include $O[(CH_2)_nO]_mCH_3$, $O(CH_2)_nOCH_3$, $O(CH_2)_nNH_2$, $O(CH_2)_nCH_3$, $O(CH_2)_nONH_2$, and $O(CH_2)_nON[(CH_2)_nCH_3)]_2$, where n and m are from 1 to about 10. In other embodiments, dsRNAs include one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an iRNA, or a group for improving the pharmacodynamic properties of an iRNA, and other substituents having similar properties. In some embodiments, the modification includes a 2'-methoxyethoxy (2'-O—$CH_2CH_2OCH_3$, also known as 2'-O-(2-methoxyethyl) or 2'-MOE) (Martin et al., *Helv. Chim. Acta*, 1995, 78:486-504) i.e., an alkoxy-alkoxy group. Another exemplary modification is 2'-dimethylaminooxyethoxy, i.e., a $O(CH_2)_2ON(CH_3)_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—$CH_2$—O—$CH_2$—$N(CH_3)_2$. Further exemplary modifications include: 5'-Me-2'-F nucleotides, 5'-Me-2'-OMe nucleotides, 5'-Me-2'-deoxynucleotides, (both R and S isomers in these three families); 2'-alkoxyalkyl; and 2'-NMA (N-methylacetamide).

Other modifications include 2'-methoxy (2'-$OCH_3$), 2'-aminopropoxy (2'-$OCH_2CH_2CH_2NH_2$) and 2'-fluoro (2'-F). Similar modifications can also be made at other positions on the RNA of an iRNA, particularly the 3' position of the sugar on the 3' terminal nucleotide or in 2'-5' linked dsRNAs and the 5' position of 5' terminal nucleotide. iRNAs can also have sugar mimetics such as cyclobutyl moieties in place of the pentofuranosyl sugar. Representative US patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application. The entire contents of each of the foregoing are hereby incorporated herein by reference.

An iRNA can also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C), and uracil (U). Modified nucleobases include other synthetic and natural nucleobases such as deoxy-thymine (dT), 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer Science And Engineering, pages 858-859, Kroschwitz, J. L, ed. John Wiley & Sons, 1990, these disclosed by Englisch et al., Angewandte Chemie, International Edition, 1991, 30, 613, and those disclosed by Sanghvi, Y S., Chapter 15, dsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the invention. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative U.S. patents that teach the preparation of certain of the above noted modified nucleobases as well as other modified nucleobases include, but are not limited to, the above noted U.S. Pat. Nos. 3,687,808, 4,845,205; 5,130, 30; 5,134,066; 5,175,273; 5,367,066; 5,432,272; 5,457,187; 5,459,255; 5,484,908; 5,502,177; 5,525,711; 5,552,540; 5,587,469; 5,594,121, 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, the entire contents of each of which are hereby incorporated herein by reference.

The RNA of an iRNA can also be modified to include one or more locked nucleic acids (LNA). A locked nucleic acid is a nucleotide having a modified ribose moiety in which the ribose moiety comprises an extra bridge connecting the 2' and 4' carbons. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12): 3185-3193).

In some embodiments, the RNA of an iRNA can also be modified to include one or more bicyclic sugar moieties. A "bicyclic sugar" is a furanosyl ring modified by the bridging of two atoms. A "bicyclic nucleoside" ("BNA") is a nucleoside having a sugar moiety comprising a bridge connecting two carbon atoms of the sugar ring, thereby forming a bicyclic ring system. In certain embodiments, the bridge connects the 4'-carbon and the 2'-carbon of the sugar ring. Thus, in some embodiments an agent of the invention may include one or more locked nucleic acids (LNA). A locked nucleic acid is a nucleotide having a modified ribose moiety in which the ribose moiety comprises an extra bridge connecting the 2' and 4' carbons. In other words, an LNA is a nucleotide comprising a bicyclic sugar moiety comprising a 4'-CH$_2$—O-2' bridge. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12):3185-3193). Examples of bicyclic nucleosides for use in the polynucleotides of the invention include without limitation nucleosides comprising a bridge between the 4' and the 2' ribosyl ring atoms. In certain embodiments, the antisense polynucleotide agents of the invention include one or more bicyclic nucleosides comprising a 4' to 2' bridge. Examples of such 4' to 2' bridged bicyclic nucleosides, include but are not limited to 4'-(CH$_2$)—O-2' (LNA); 4'-(CH$_2$)—S-2'; 4'-(CH$_2$)$_2$—O-2' (ENA); 4'-CH(CH$_3$)—O-2' (also referred to as "constrained ethyl" or "cEt") and 4'-CH(CH$_2$OCH$_3$)—O-2' (and analogs thereof, see, e.g., U.S. Pat. No. 7,399,845); 4'-C(CH$_3$)(CH$_3$)—O-2' (and analogs thereof; see e.g., U.S. Pat. No. 8,278,283); 4'-CH$_2$—N (OCH$_3$)-2' (and analogs thereof, see e.g., U.S. Pat. No. 8,278,425); 4'-CH$_2$—O—N(CH$_3$)-2' (see, e.g., U.S. Patent Publication No. 2004/0171570); 4'-CH$_2$—N(R)—O-2', wherein R is H, C1-C12 alkyl, or a protecting group (see, e.g., U.S. Pat. No. 7,427,672); 4'-CH$_2$—C(H)(CH$_3$)-2' (see, e.g., Chattopadhyaya et al., *J. Org. Chem.*, 2009, 74, 118-134); and 4'-CH$_2$—C(=CH$_2$)-2' (and analogs thereof, see, e.g., U.S. Pat. No. 8,278,426). The entire contents of each of the foregoing are hereby incorporated herein by reference.

Additional representative U.S. patents and U.S. patenttent Publications that teach the preparation of locked nucleic acid nucleotides include, but are not limited to, the following: U.S. Pat. Nos. 6,268,490; 6,525,191; 6,670,461; 6,770,748; 6,794,499; 6,998,484; 7,053,207; 7,034,133; 7,084,125; 7,399,845; 7,427,672; 7,569,686; 7,741,457; 8,022,193; 8,030,467; 8,278,425; 8,278,426; 8,278,283; US 2008/0039618; and US 2009/0012281, the entire contents of each of which are hereby incorporated herein by reference.

Any of the foregoing bicyclic nucleosides can be prepared having one or more stereochemical sugar configurations including for example α-L-ribofuranose and β-D-ribofuranose (see WO 99/14226).

The RNA of an iRNA can also be modified to include one or more constrained ethyl nucleotides. As used herein, a "constrained ethyl nucleotide" or "cEt" is a locked nucleic acid comprising a bicyclic sugar moiety comprising a 4'-CH(CH$_3$)—O-2' bridge. In one embodiment, a constrained ethyl nucleotide is in the S conformation referred to herein as "S-cEt."

An iRNA of the invention may also include one or more "conformationally restricted nucleotides" ("CRN"). CRN are nucleotide analogs with a linker connecting the C2' and C4' carbons of ribose or the C3 and —C5' carbons of ribose. CRN lock the ribose ring into a stable conformation and increase the hybridization affinity to mRNA. The linker is of sufficient length to place the oxygen in an optimal position for stability and affinity resulting in less ribose ring puckering.

Representative publications that teach the preparation of certain of the above noted CRN include, but are not limited to, U.S. Patent Publication No. 2013/0190383; and PCT publication WO 2013/036868, the entire contents of each of which are hereby incorporated herein by reference.

In some embodiments, an iRNA of the invention comprises one or more monomers that are UNA (unlocked nucleic acid) nucleotides. UNA is unlocked acyclic nucleic acid, wherein any of the bonds of the sugar has been removed, forming an unlocked "sugar" residue. In one example, UNA also encompasses monomer with bonds between C1'-C4' have been removed (i.e. the covalent carbon-oxygen-carbon bond between the C1' and C4' carbons). In another example, the C2'-C3' bond (i.e. the covalent carbon-carbon bond between the C2' and C3' carbons) of the sugar has been removed (see *Nuc. Acids Symp. Series*, 52, 133-134 (2008) and Fluiter et al., *Mol. Biosyst.*, 2009, 10, 1039 hereby incorporated by reference).

Representative U.S. publications that teach the preparation of UNA include, but are not limited to, U.S. Pat. No. 8,314,227; and U.S. Patent Publication Nos. 2013/0096289; 2013/0011922; and 2011/0313020, the entire contents of each of which are hereby incorporated herein by reference.

Potentially stabilizing modifications to the ends of RNA molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-O-deoxythymidine (ether), N-(aminocaproyl)-4-hydroxyprolinol (Hyp-C6-amino), 2-docosanoyl-uridine-3"-phosphate, inverted base dT(idT) and others. Disclosure of this modification can be found in PCT Publication No. WO 2011/005861.

Other modifications of the nucleotides of an iRNA of the invention include a 5' phosphate or 5' phosphate mimic, e.g., a 5'-terminal phosphate or phosphate mimic on the antisense strand of an iRNA. Suitable phosphate mimics are disclosed in, for example U.S. Patent Publication No. 2012/0157511, the entire contents of which are incorporated herein by reference.

A. Modified iRNAs Comprising Motifs of the Invention

In certain aspects of the invention, the double stranded RNA agents of the invention include agents with chemical modifications as disclosed, for example, in WO2013/075035, the entire contents of each of which are incorporated herein by reference. WO2013/075035 provides motifs of three identical modifications on three consecutive nucleotides into a sense strand or antisense strand of a dsRNAi agent, particularly at or near the cleavage site. In some embodiments, the sense strand and antisense strand of the dsRNAi agent may otherwise be completely modified. The introduction of these motifs interrupts the modification pattern, if present, of the sense or antisense strand. The dsRNAi agent may be optionally conjugated with a GalNAc derivative ligand, for instance on the sense strand.

More specifically, when the sense strand and antisense strand of the double stranded RNA agent are completely modified to have one or more motifs of three identical modifications on three consecutive nucleotides at or near the cleavage site of at least one strand of a dsRNAi agent, the gene silencing activity of the dsRNAi agent was observed.

Accordingly, the invention provides double stranded RNA agents capable of inhibiting the expression of a target gene (i.e., a solute carrier family member gene, e.g., an SLC30A10 gene or an SLC39A8 gene) in vivo. The RNAi agent comprises a sense strand and an antisense strand. Each strand of the RNAi agent may be, for example, 17-30 nucleotides in length, 25-30 nucleotides in length, 27-30 nucleotides in length, 19-25 nucleotides in length, 19-23 nucleotides in length, 19-21 nucleotides in length, 21-25 nucleotides in length, or 21-23 nucleotides in length.

The sense strand and antisense strand typically form a duplex double stranded RNA ("dsRNA"), also referred to herein as "dsRNAi agent." The duplex region of a dsRNAi agent may be, for example, the duplex region can be 27-30 nucleotide pairs in length, 19-25 nucleotide pairs in length, 19-23 nucleotide pairs in length, 19-21 nucleotide pairs in length, 21-25 nucleotide pairs in length, or 21-23 nucleotide pairs in length. In another example, the duplex region is selected from 19, 20, 21, 22, 23, 24, 25, 26, and 27 nucleotides in length.

In certain embodiments, the dsRNAi agent may contain one or more overhang regions or capping groups at the 3'-end, 5'-end, or both ends of one or both strands. The overhang can be, independently, 1-6 nucleotides in length, for instance 2-6 nucleotides in length, 1-5 nucleotides in length, 2-5 nucleotides in length, 1-4 nucleotides in length, 2-4 nucleotides in length, 1-3 nucleotides in length, 2-3 nucleotides in length, or 1-2 nucleotides in length. In certain embodiments, the overhang regions can include extended overhang regions as provided above. The overhangs can be the result of one strand being longer than the other, or the result of two strands of the same length being staggered. The overhang can form a mismatch with the target mRNA or it can be complementary to the gene sequences being targeted or can be another sequence. The first and second strands can also be joined, e.g., by additional bases to form a hairpin, or by other non-base linkers.

In certain embodiments, the nucleotides in the overhang region of the dsRNAi agent can each independently be a modified or unmodified nucleotide including, but no limited to 2'-sugar modified, such as, 2'-F, 2'-O-methyl, thymidine (T), 2'-O-methoxyethyl-5-methyluridine (Teo), 2'-O-methoxyethyladenosine (Aeo), 2'-O-methoxyethyl-5-methylcytidine (m5Ceo), and any combinations thereof. For example, TT can be an overhang sequence for either end on either strand. The overhang can form a mismatch with the target mRNA or it can be complementary to the gene sequences being targeted or can be another sequence.

The 5'- or 3'-overhangs at the sense strand, antisense strand, or both strands of the dsRNAi agent may be phosphorylated. In some embodiments, the overhang region(s) contains two nucleotides having a phosphorothioate between the two nucleotides, where the two nucleotides can be the same or different. In some embodiments, the overhang is present at the 3'-end of the sense strand, antisense strand, or both strands. In some embodiments, this 3'-overhang is present in the antisense strand. In some embodiments, this 3'-overhang is present in the sense strand.

The dsRNAi agent may contain only a single overhang, which can strengthen the interference activity of the RNAi, without affecting its overall stability. For example, the single-stranded overhang may be located at the 3'-end of the sense strand or, alternatively, at the 3'-end of the antisense strand. The RNAi may also have a blunt end, located at the 5'-end of the antisense strand (or the 3'-end of the sense strand) or vice versa. Generally, the antisense strand of the dsRNAi agent has a nucleotide overhang at the 3'-end, and the 5'-end is blunt. While not wishing to be bound by theory, the asymmetric blunt end at the 5'-end of the antisense strand and 3'-end overhang of the antisense strand favor the guide strand loading into RISC process.

In certain embodiments, the dsRNAi agent is a double ended bluntmer of 19 nucleotides in length, wherein the sense strand contains at least one motif of three 2'-F modifications on three consecutive nucleotides at positions 7, 8, 9 from the 5' end. The antisense strand contains at least one motif of three 2'-O-methyl modifications on three consecutive nucleotides at positions 11, 12, 13 from the 5' end.

In other embodiments, the dsRNAi agent is a double ended bluntmer of 20 nucleotides in length, wherein the sense strand contains at least one motif of three 2'-F modifications on three consecutive nucleotides at positions 8, 9, 10 from the 5' end. The antisense strand contains at least one motif of three 2'-O-methyl modifications on three consecutive nucleotides at positions 11, 12, 13 from the 5' end.

In yet other embodiments, the dsRNAi agent is a double ended bluntmer of 21 nucleotides in length, wherein the sense strand contains at least one motif of three 2'-F modifications on three consecutive nucleotides at positions 9, 10, 11 from the 5' end. The antisense strand contains at least one motif of three 2'-O-methyl modifications on three consecutive nucleotides at positions 11, 12, 13 from the 5' end.

In certain embodiments, the dsRNAi agent comprises a 21 nucleotide sense strand and a 23 nucleotide antisense strand, wherein the sense strand contains at least one motif of three 2'-F modifications on three consecutive nucleotides at positions 9, 10, 11 from the 5' end; the antisense strand contains at least one motif of three 2'-O-methyl modifications on three consecutive nucleotides at positions 11, 12, 13 from the 5' end, wherein one end of the RNAi agent is blunt, while the other end comprises a 2 nucleotide overhang. Preferably, the 2 nucleotide overhang is at the 3'-end of the antisense strand.

When the 2-nucleotide overhang is at the 3'-end of the antisense strand, there may be two phosphorothioate internucleotide linkages between the terminal three nucleotides, wherein two of the three nucleotides are the overhang nucleotides, and the third nucleotide is a paired nucleotide next to the overhang nucleotide. In one embodiment, the RNAi agent additionally has two phosphorothioate internucleotide linkages between the terminal three nucleotides at both the 5'-end of the sense strand and at the 5'-end of the antisense strand. In certain embodiments, every nucleotide in the sense strand and the antisense strand of the dsRNAi agent, including the nucleotides that are part of the motifs are modified nucleotides. In certain embodiments each residue is independently modified with a 2'-O-methyl or 3'-fluoro, e.g., in an alternating motif Optionally, the dsRNAi agent further comprises a ligand (preferably GalNAc$_3$).

In certain embodiments, the dsRNAi agent comprises a sense and an antisense strand, wherein the sense strand is 25-30 nucleotide residues in length, wherein starting from the 5' terminal nucleotide (position 1) positions 1 to 23 of the first strand comprise at least 8 ribonucleotides; the antisense strand is 36-66 nucleotide residues in length and, starting from the 3' terminal nucleotide, comprises at least 8 ribonucleotides in the positions paired with positions 1-23 of sense strand to form a duplex; wherein at least the 3' terminal nucleotide of antisense strand is unpaired with sense strand, and up to 6 consecutive 3' terminal nucleotides are unpaired with sense strand, thereby forming a 3' single stranded overhang of 1-6 nucleotides; wherein the 5' terminus of antisense strand comprises from 10-30 consecutive nucleotides which are unpaired with sense strand, thereby forming a 10-30 nucleotide single stranded 5' overhang; wherein at least the sense strand 5' terminal and 3' terminal nucleotides are base paired with nucleotides of antisense strand when sense and antisense strands are aligned for maximum complementarity, thereby forming a substantially duplexed region between sense and antisense strands; and antisense strand is sufficiently complementary to a target RNA along at least 19 ribonucleotides of antisense strand length to reduce target gene expression when the double stranded nucleic acid is introduced into a mammalian cell; and wherein the sense strand contains at least one motif of three 2'-F modifications on three consecutive nucleotides, where at least one of the motifs occurs at or near the cleavage site.

The antisense strand contains at least one motif of three 2'-O-methyl modifications on three consecutive nucleotides at or near the cleavage site.

In certain embodiments, the dsRNAi agent comprises sense and antisense strands, wherein the dsRNAi agent comprises a first strand having a length which is at least 25 and at most 29 nucleotides and a second strand having a length which is at most 30 nucleotides with at least one motif of three 2'-O-methyl modifications on three consecutive nucleotides at position 11, 12, 13 from the 5' end; wherein the 3' end of the first strand and the 5' end of the second strand form a blunt end and the second strand is 1-4 nucleotides longer at its 3' end than the first strand, wherein the duplex region which is at least 25 nucleotides in length, and the second strand is sufficiently complementary to a target mRNA along at least 19 nucleotide of the second strand length to reduce target gene expression when the RNAi agent is introduced into a mammalian cell, and wherein Dicer cleavage of the dsRNAi agent preferentially results in an siRNA comprising the 3'-end of the second strand, thereby reducing expression of the target gene in the mammal. Optionally, the dsRNAi agent further comprises a ligand.

In certain embodiments, the sense strand of the dsRNAi agent contains at least one motif of three identical modifications on three consecutive nucleotides, where one of the motifs occurs at the cleavage site in the sense strand.

In certain embodiments, the antisense strand of the dsRNAi agent can also contain at least one motif of three identical modifications on three consecutive nucleotides, where one of the motifs occurs at or near the cleavage site in the antisense strand.

For a dsRNAi agent having a duplex region of 19-23 nucleotides in length, the cleavage site of the antisense strand is typically around the 10, 11, and 12 positions from the 5'-end. Thus the motifs of three identical modifications may occur at the 9, 10, 11 positions; the 10, 11, 12 positions; the 11, 12, 13 positions; the 12, 13, 14 positions; or the 13, 14, 15 positions of the antisense strand, the count starting from the first nucleotide from the 5'-end of the antisense strand, or, the count starting from the first paired nucleotide within the duplex region from the 5'-end of the antisense strand. The cleavage site in the antisense strand may also change according to the length of the duplex region of the dsRNAi agent from the 5'-end.

The sense strand of the dsRNAi agent may contain at least one motif of three identical modifications on three consecutive nucleotides at the cleavage site of the strand; and the antisense strand may have at least one motif of three identical modifications on three consecutive nucleotides at or near the cleavage site of the strand. When the sense strand and the antisense strand form a dsRNA duplex, the sense strand and the antisense strand can be so aligned that one motif of the three nucleotides on the sense strand and one motif of the three nucleotides on the antisense strand have at least one nucleotide overlap, i.e., at least one of the three nucleotides of the motif in the sense strand forms a base pair with at least one of the three nucleotides of the motif in the antisense strand. Alternatively, at least two nucleotides may overlap, or all three nucleotides may overlap.

In some embodiments, the sense strand of the dsRNAi agent may contain more than one motif of three identical modifications on three consecutive nucleotides. The first motif may occur at or near the cleavage site of the strand and the other motifs may be a wing modification. The term "wing modification" herein refers to a motif occurring at another portion of the strand that is separated from the motif at or near the cleavage site of the same strand. The wing modification is either adjacent to the first motif or is separated by at least one or more nucleotides. When the motifs are immediately adjacent to each other then the chemistries of the motifs are distinct from each other, and when the motifs are separated by one or more nucleotide than the chemistries can be the same or different. Two or more wing modifications may be present. For instance, when two wing modifications are present, each wing modification may occur at one end relative to the first motif which is at or near cleavage site or on either side of the lead motif.

Like the sense strand, the antisense strand of the dsRNAi agent may contain more than one motifs of three identical modifications on three consecutive nucleotides, with at least one of the motifs occurring at or near the cleavage site of the strand. This antisense strand may also contain one or more wing modifications in an alignment similar to the wing modifications that may be present on the sense strand.

In some embodiments, the wing modification on the sense strand or antisense strand of the dsRNAi agent typically does not include the first one or two terminal nucleotides at the 3'-end, 5'-end, or both ends of the strand.

In other embodiments, the wing modification on the sense strand or antisense strand of the dsRNAi agent typically does not include the first one or two paired nucleotides within the duplex region at the 3'-end, 5'-end, or both ends of the strand.

When the sense strand and the antisense strand of the dsRNAi agent each contain at least one wing modification, the wing modifications may fall on the same end of the duplex region, and have an overlap of one, two, or three nucleotides.

When the sense strand and the antisense strand of the dsRNAi agent each contain at least two wing modifications, the sense strand and the antisense strand can be so aligned that two modifications each from one strand fall on one end of the duplex region, having an overlap of one, two, or three nucleotides; two modifications each from one strand fall on the other end of the duplex region, having an overlap of one, two or three nucleotides; two modifications one strand fall on each side of the lead motif, having an overlap of one, two or three nucleotides in the duplex region.

In some embodiments, every nucleotide in the sense strand and antisense strand of the dsRNAi agent, including the nucleotides that are part of the motifs, may be modified. Each nucleotide may be modified with the same or different modification which can include one or more alteration of one or both of the non-linking phosphate oxygens or of one or more of the linking phosphate oxygens; alteration of a constituent of the ribose sugar, e.g., of the 2'-hydroxyl on the ribose sugar; wholesale replacement of the phosphate moiety with "dephospho" linkers; modification or replacement of a naturally occurring base; and replacement or modification of the ribose-phosphate backbone.

As nucleic acids are polymers of subunits, many of the modifications occur at a position which is repeated within a nucleic acid, e.g., a modification of a base, or a phosphate moiety, or a non-linking O of a phosphate moiety. In some cases the modification will occur at all of the subject positions in the nucleic acid but in many cases it will not. By way of example, a modification may only occur at a 3'- or 5' terminal position, may only occur in a terminal region, e.g., at a position on a terminal nucleotide or in the last 2, 3, 4, 5, or 10 nucleotides of a strand. A modification may occur in a double strand region, a single strand region, or in both. A modification may occur only in the double strand region of an RNA or may only occur in a single strand region of a RNA. For example, a phosphorothioate modification at a non-linking O position may only occur at one or both termini, may only occur in a terminal region, e.g., at a position on a terminal nucleotide or in the last 2, 3, 4, 5, or 10 nucleotides of a strand, or may occur in double strand and single strand regions, particularly at termini. The 5'-end or ends can be phosphorylated.

It may be possible, e.g., to enhance stability, to include particular bases in overhangs, or to include modified nucleotides or nucleotide surrogates, in single strand overhangs, e.g., in a 5'- or 3'-overhang, or in both. For example, it can be desirable to include purine nucleotides in overhangs. In some embodiments all or some of the bases in a 3'- or 5'-overhang may be modified, e.g., with a modification described herein. Modifications can include, e.g., the use of modifications at the 2' position of the ribose sugar with modifications that are known in the art, e.g., the use of deoxyribonucleotides, 2'-deoxy-2'-fluoro (2'-F) or 2'-O-methyl modified instead of the ribosugar of the nucleobase, and modifications in the phosphate group, e.g., phosphorothioate modifications. Overhangs need not be homologous with the target sequence.

In some embodiments, each residue of the sense strand and antisense strand is independently modified with LNA, CRN, cET, UNA, HNA, CeNA, 2'-methoxyethyl, 2'-O-methyl, 2'-O-allyl, 2'-C-allyl, 2'-deoxy, 2'-hydroxyl, or 2'-fluoro. The strands can contain more than one modification. In one embodiment, each residue of the sense strand and antisense strand is independently modified with 2'-O-methyl or 2'-fluoro.

At least two different modifications are typically present on the sense strand and antisense strand. Those two modifications may be the 2'-O-methyl or 2'-fluoro modifications, or others.

In certain embodiments, the $N_a$ or $N_b$ comprise modifications of an alternating pattern. The term "alternating motif" as used herein refers to a motif having one or more modifications, each modification occurring on alternating nucleotides of one strand. The alternating nucleotide may refer to one per every other nucleotide or one per every three nucleotides, or a similar pattern. For example, if A, B and C each represent one type of modification to the nucleotide, the alternating motif can be "ABABABABABAB . . . ," "AAB-BAABBAABB . . . ," "AABAABAABAAB . . . ," "AAA-BAAABAAAB . . . ," "AAABBBAAABBB . . . ," or "ABCABCABCABC . . . ," etc.

The type of modifications contained in the alternating motif may be the same or different. For example, if A, B, C, D each represent one type of modification on the nucleotide, the alternating pattern, i.e., modifications on every other nucleotide, may be the same, but each of the sense strand or antisense strand can be selected from several possibilities of modifications within the alternating motif such as "ABA-BAB . . . ", "ACACAC . . . " "BDBDBD . . . " or "CDCDCD . . . ," etc.

In some embodiments, the dsRNAi agent of the invention comprises the modification pattern for the alternating motif on the sense strand relative to the modification pattern for the alternating motif on the antisense strand is shifted. The shift may be such that the modified group of nucleotides of the sense strand corresponds to a differently modified group of nucleotides of the antisense strand and vice versa. For example, the sense strand when paired with the antisense strand in the dsRNA duplex, the alternating motif in the sense strand may start with "ABABAB" from 5' to 3' of the strand and the alternating motif in the antisense strand may start with "BABABA" from 5' to 3' of the strand within the duplex region. As another example, the alternating motif in the sense strand may start with "AABBAABB" from 5' to 3' of the strand and the alternating motif in the antisense strand may start with "BBAABBAA" from 5' to 3' of the strand within the duplex region, so that there is a complete or partial shift of the modification patterns between the sense strand and the antisense strand.

In some embodiments, the dsRNAi agent comprises the pattern of the alternating motif of 2'-O-methyl modification and 2'-F modification on the sense strand initially has a shift relative to the pattern of the alternating motif of 2'-O-methyl modification and 2'-F modification on the antisense strand initially, i.e., the 2'-O-methyl modified nucleotide on the sense strand base pairs with a 2'-F modified nucleotide on the antisense strand and vice versa. The 1 position of the sense strand may start with the 2'-F modification, and the 1 position of the antisense strand may start with the 2'-O-methyl modification.

The introduction of one or more motifs of three identical modifications on three consecutive nucleotides to the sense strand or antisense strand interrupts the initial modification pattern present in the sense strand or antisense strand. This interruption of the modification pattern of the sense or antisense strand by introducing one or more motifs of three identical modifications on three consecutive nucleotides to the sense or antisense strand may enhance the gene silencing activity against the target gene.

In some embodiments, when the motif of three identical modifications on three consecutive nucleotides is introduced to any of the strands, the modification of the nucleotide next to the motif is a different modification than the modification of the motif. For example, the portion of the sequence containing the motif is " . . . $N_a$YYY$N_b$ . . . ," where "Y" represents the modification of the motif of three identical modifications on three consecutive nucleotide, and "$N_a$" and "$N_b$" represent a modification to the nucleotide next to the motif "YYY" that is different than the modification of Y, and where $N_a$ and $N_b$ can be the same or different modifications. Alternatively, $N_a$ or $N_b$ may be present or absent when there is a wing modification present.

The iRNA may further comprise at least one phosphorothioate or methylphosphonate internucleotide linkage. The phosphorothioate or methylphosphonate internucleotide linkage modification may occur on any nucleotide of the sense strand, antisense strand, or both strands in any position of the strand. For instance, the internucleotide linkage modification may occur on every nucleotide on the sense strand or antisense strand; each internucleotide linkage modification may occur in an alternating pattern on the sense strand or antisense strand; or the sense strand or antisense strand may contain both internucleotide linkage modifications in an alternating pattern. The alternating pattern of the internucleotide linkage modification on the sense strand may be the same or different from the antisense strand, and the alternating pattern of the internucleotide linkage modification on the sense strand may have a shift relative to the alternating pattern of the internucleotide linkage modification on the antisense strand. In one embodiment, a double-stranded RNAi agent comprises 6-8 phosphorothioate internucleotide linkages. In some embodiments, the antisense strand comprises two phosphorothioate internucleotide linkages at the 5'-end and two phosphorothioate internucleotide linkages at the 3'-end, and the sense strand comprises at least two phosphorothioate internucleotide linkages at either the 5'-end or the 3'-end.

In some embodiments, the dsRNAi agent comprises a phosphorothioate or methylphosphonate internucleotide linkage modification in the overhang region. For example, the overhang region may contain two nucleotides having a phosphorothioate or methylphosphonate internucleotide linkage between the two nucleotides. Internucleotide linkage modifications also may be made to link the overhang nucleotides with the terminal paired nucleotides within the duplex region. For example, at least 2, 3, 4, or all the overhang nucleotides may be linked through phosphorothioate or methylphosphonate internucleotide linkage, and optionally, there may be additional phosphorothioate or methylphosphonate internucleotide linkages linking the overhang nucleotide with a paired nucleotide that is next to the overhang nucleotide. For instance, there may be at least two phosphorothioate internucleotide linkages between the terminal three nucleotides, in which two of the three nucleotides are overhang nucleotides, and the third is a paired nucleotide next to the overhang nucleotide. These terminal three nucleotides may be at the 3'-end of the antisense strand, the 3'-end of the sense strand, the 5'-end of the antisense strand, or the 5' end of the antisense strand.

In some embodiments, the 2-nucleotide overhang is at the 3'-end of the antisense strand, and there are two phosphorothioate internucleotide linkages between the terminal three nucleotides, wherein two of the three nucleotides are the overhang nucleotides, and the third nucleotide is a paired nucleotide next to the overhang nucleotide. Optionally, the dsRNAi agent may additionally have two phosphorothioate internucleotide linkages between the terminal three nucleotides at both the 5'-end of the sense strand and at the 5'-end of the antisense strand.

In one embodiment, the dsRNAi agent comprises mismatch(es) with the target, within the duplex, or combinations thereof. The mismatch may occur in the overhang region or the duplex region. The base pair may be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In certain embodiments, the dsRNAi agent comprises at least one of the first 1, 2, 3, 4, or 5 base pairs within the duplex regions from the 5'-end of the antisense strand independently selected from the group of: A:U, G:U, I:C, and mismatched pairs, e.g., non-canonical or other than canonical pairings or pairings which include a universal base, to promote the dissociation of the antisense strand at the 5'-end of the duplex.

In certain embodiments, the nucleotide at the 1 position within the duplex region from the 5'-end in the antisense strand is selected from A, dA, dU, U, and dT. Alternatively, at least one of the first 1, 2, or 3 base pair within the duplex region from the 5'-end of the antisense strand is an AU base pair. For example, the first base pair within the duplex region from the 5'-end of the antisense strand is an AU base pair.

In other embodiments, the nucleotide at the 3'-end of the sense strand is deoxy-thymine (dT) or the nucleotide at the 3'-end of the antisense strand is deoxy-thymine (dT). For example, there is a short sequence of deoxy-thymine nucleotides, for example, two dT nucleotides on the 3'-end of the sense, antisense strand, or both strands.

In certain embodiments, the sense strand sequence may be represented by formula (I):

$$5'n_p\text{-}N_a\text{-}(XXX)_i\text{-}N_b\text{-}YYY\text{-}N_b\text{-}(ZZZ)_j\text{-}N_a\text{-}n_q3' \qquad (I)$$

wherein:
i and j are each independently 0 or 1;
p and q are each independently 0-6;
each $N_a$ independently represents an oligonucleotide sequence comprising 0-25 modified nucleotides, each sequence comprising at least two differently modified nucleotides;
each $N_b$ independently represents an oligonucleotide sequence comprising 0-10 modified nucleotides;
each $n_p$ and $n_q$ independently represent an overhang nucleotide;
wherein $N_b$ and Y do not have the same modification; and
XXX, YYY, and ZZZ each independently represent one motif of three identical modifications on three consecutive nucleotides. Preferably YYY is all 2'-F modified nucleotides.

In some embodiments, the $N_a$ or $N_b$ comprises modifications of alternating pattern.

In some embodiments, the YYY motif occurs at or near the cleavage site of the sense strand. For example, when the dsRNAi agent has a duplex region of 17-23 nucleotides in length, the YYY motif can occur at or the vicinity of the cleavage site (e.g.: can occur at positions 6, 7, 8; 7, 8, 9; 8, 9, 10; 9, 10, 11; 10, 11, 12; or 11, 12, 13) of the sense strand, the count starting from the first nucleotide, from the 5'-end; or optionally, the count starting at the first paired nucleotide within the duplex region, from the 5'-end.

In one embodiment, i is 1 and j is 0, or i is 0 and j is 1, or both i and j are 1. The sense strand can therefore be represented by the following formulas:

$$5'n_p\text{-}N_a\text{-}YYY\text{-}N_b\text{-}ZZZ\text{-}N_a\text{-}n_q3' \qquad (Ib);$$

$$5'n_p\text{-}N_a\text{-}XXX\text{-}N_b\text{-}YYY\text{-}N_a\text{-}n_q3' \qquad (Ic); \text{ or}$$

$$5'n_p\text{-}N_a\text{-}XXX\text{-}N_b\text{-}YYY\text{-}N_b\text{-}ZZZ\text{-}N_a\text{-}n_q3' \qquad (Id).$$

When the sense strand is represented by formula (Ib), $N_b$ represents an oligonucleotide sequence comprising 0-10, 0-7, 0-5, 0-4, 0-2, or 0 modified nucleotides. Each $N_a$ independently can represent an oligonucleotide sequence comprising 2-20, 2-15, or 2-10 modified nucleotides.

When the sense strand is represented as formula (Ic), $N_b$ represents an oligonucleotide sequence comprising 0-10, 0-7, 0-10, 0-7, 0-5, 0-4, 0-2, or 0 modified nucleotides. Each $N_a$ can independently represent an oligonucleotide sequence comprising 2-20, 2-15, or 2-10 modified nucleotides.

When the sense strand is represented as formula (Id), each $N_b$ independently represents an oligonucleotide sequence comprising 0-10, 0-7, 0-5, 0-4, 0-2, or 0 modified nucleotides. Preferably, $N_b$ is 0, 1, 2, 3, 4, 5, or 6 Each $N_a$ can independently represent an oligonucleotide sequence comprising 2-20, 2-15, or 2-10 modified nucleotides.

Each of X, Y and Z may be the same or different from each other.

In other embodiments, i is 0 and j is 0, and the sense strand may be represented by the formula:

$$5'n_p\text{-}N_a\text{-}YYY\text{-}N_a\text{-}n_q3' \qquad (Ia).$$

When the sense strand is represented by formula (Ia), each $N_a$ independently can represent an oligonucleotide sequence comprising 2-20, 2-15, or 2-10 modified nucleotides.

In one embodiment, the antisense strand sequence of the RNAi may be represented by formula (II):

$$5'n_q\text{-}N_a'\text{-}(Z'Z')_l\text{-}N_b'\text{-}Y'Y'Y'\text{-}N_b'\text{-}(X'X'X')_k\text{-}N'_a\text{-}n_p'3' \quad (II)$$

wherein:
k and l are each independently 0 or 1;
p' and q' are each independently 0-6;
each $N_a'$ independently represents an oligonucleotide sequence comprising 0-25 modified nucleotides, each sequence comprising at least two differently modified nucleotides;
each $N_b'$ independently represents an oligonucleotide sequence comprising 0-10 modified nucleotides;
each $n_p'$ and $n_q'$ independently represent an overhang nucleotide;
wherein $N_b$ and $N_b'$ do not have the same modification; and
X'X'X', Y'Y'Y', and Z'Z'Z' each independently represent one motif of three identical modifications on three consecutive nucleotides.

In some embodiments, the $N_a'$ or $N_b'$ comprises modifications of alternating pattern.

The Y'Y'Y' motif occurs at or near the cleavage site of the antisense strand. For example, when the dsRNAi agent has a duplex region of 17-23 nucleotides in length, the Y'Y'Y' motif can occur at positions 9, 10, 11; 10, 11, 12; 11, 12, 13; 12, 13, 14; or 13, 14, 15 of the antisense strand, with the count starting from the first nucleotide, from the 5'-end; or optionally, the count starting at the first paired nucleotide within the duplex region, from the 5'-end. Preferably, the Y'Y'Y' motif occurs at positions 11, 12, 13.

In certain embodiments, Y'Y'Y' motif is all 2'-OMe modified nucleotides.

In certain embodiments, k is 1 and l is 0, or k is 0 and l is 1, or both k and l are 1.

The antisense strand can therefore be represented by the following formulas:

$$5'n_q\text{-}N_a'\text{-}Z'Z'Z'\text{-}N_b'\text{-}Y'Y'Y'\text{-}N_a'\text{-}n_p'3' \quad (IIb);$$

$$5'n_q\text{-}N_a'\text{-}Y'Y'Y'\text{-}N_b'\text{-}X'X'X'\text{-}n_p'3' \quad (IIc); \text{ or}$$

$$5'n_q\text{-}N_a'\text{-}Z'Z'Z'\text{-}N_b'\text{-}Y'Y'Y'\text{-}N_b'\text{-}X'X'X'\text{-}N_a'\text{-}n_p'3' \quad (IId).$$

When the antisense strand is represented by formula (IIb), $N_b'$ represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides.

When the antisense strand is represented as formula (IIc), $N_b'$ represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides.

When the antisense strand is represented as formula (IId), each $N_b'$ independently represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides. Preferably, $N_b$ is 0, 1, 2, 3, 4, 5, or 6.

In other embodiments, k is 0 and l is 0 and the antisense strand may be represented by the formula:

$$5'n_p\text{-}N_a\text{-}Y'Y'Y'\text{-}N_a\text{-}n_q3' \quad (Ia).$$

When the antisense strand is represented as formula (IIa), each $N_a'$ independently represents an oligonucleotide sequence comprising 2-20, 2-15, or 2-10 modified nucleotides. Each of X', Y' and Z' may be the same or different from each other.

Each nucleotide of the sense strand and antisense strand may be independently modified with LNA, CRN, UNA, cEt, HNA, CeNA, 2'-methoxyethyl, 2'-O-methyl, 2'-O-allyl, 2'-C-allyl, 2'-hydroxyl, or 2'-fluoro. For example, each nucleotide of the sense strand and antisense strand is independently modified with 2'-O-methyl or 2'-fluoro. Each X, Y, Z, X', Y', and Z', in particular, may represent a 2'-O-methyl modification or a 2'-fluoro modification.

In some embodiments, the sense strand of the dsRNAi agent may contain YYY motif occurring at 9, 10, and 11 positions of the strand when the duplex region is 21 nt, the count starting from the first nucleotide from the 5'-end, or optionally, the count starting at the first paired nucleotide within the duplex region, from the 5'-end; and Y represents 2'-F modification. The sense strand may additionally contain XXX motif or ZZZ motifs as wing modifications at the opposite end of the duplex region; and XXX and ZZZ each independently represents a 2'-OMe modification or 2'-F modification.

In some embodiments the antisense strand may contain Y'Y'Y' motif occurring at positions 11, 12, 13 of the strand, the count starting from the first nucleotide from the 5'-end, or optionally, the count starting at the first paired nucleotide within the duplex region, from the 5'-end; and Y' represents 2'-O-methyl modification. The antisense strand may additionally contain X'X'X' motif or Z'Z'Z' motifs as wing modifications at the opposite end of the duplex region; and X'X'X' and Z'Z'Z' each independently represents a 2'-OMe modification or 2'-F modification.

The sense strand represented by any one of the above formulas (Ia), (Ib), (Ic), and (Id) forms a duplex with an antisense strand being represented by any one of formulas (IIa), (IIb), (IIc), and (IId), respectively.

Accordingly, the dsRNAi agents for use in the methods of the invention may comprise a sense strand and an antisense strand, each strand having 14 to 30 nucleotides, the iRNA duplex represented by formula (III):

sense: $5'n_p\text{-}N_a\text{-}(XXX)_i\text{-}N_b\text{-}YYY\text{-}N_b\text{-}(ZZZ)_j\text{-}N_a\text{-}n_q3'$ antisense: $3'n_p'\text{-}N_a'\text{-}(X'X'X')_k\text{-}N_b'\text{-}Y'Y'Y'\text{-}N_b'\text{-}(Z'Z'Z')_l\text{-}N_a'\text{-}n_q'5' \quad (III)$ wherein:
i, j, k, and l are each independently 0 or 1;
p, p', q, and q' are each independently 0-6;
each $N_a$ and $N_a'$ independently represents an oligonucleotide sequence comprising 0-25 modified nucleotides, each sequence comprising at least two differently modified nucleotides;
each $N_b$ and $N_b'$ independently represents an oligonucleotide sequence comprising 0-10 modified nucleotides;
wherein each $n_p'$, $n_p$, $n_q'$, and $n_q$, each of which may or may not be present, independently represents an overhang nucleotide; and
XXX, YYY, ZZZ, X'X'X', Y'Y'Y', and Z'Z'Z' each independently represent one motif of three identical modifications on three consecutive nucleotides.

In one embodiment, i is 0 and j is 0; or i is 1 and j is 0; or i is 0 and j is 1; or both i and j are 0; or both i and j are 1. In another embodiment, k is 0 and l is 0; or k is 1 and l is 0; k is 0 and l is 1; or both k and l are 0; or both k and l are 1.

Exemplary combinations of the sense strand and antisense strand forming an iRNA duplex include the formulas below:

$$5'n_p\text{-}N_a\text{-}YYY\text{-}N_a\text{-}n_q3'$$

$$3'n_p'\text{-}N_a'\text{-}Y'Y'Y'\text{-}N_a'n_q'5' \quad (IIIa)$$

5'$n_p$-$N_a$-YYY-$N_b$-ZZZ-$N_a$-$n_q$3'

3'$n_p$'-$N_a$'-Y'Y'Y'-$N_b$'-Z'Z'Z'-$N_a$'$n_q$'5     (IIIb)

5'$n_p$-$N_a$-XXX-$N_b$-YYY-$N_a$-$n_q$3'

3'$n_p$'-$N_a$'-X'X'X'-$N_b$'-Y'Y'Y'-$N_a$'-$n_q$'5'     (IIIc)

5'$n_p$-$N_a$-XXX-$N_b$-YYY-$N_b$-ZZZ-$N_a$-$n_q$3'

3'$n_p$'-$N_a$'-X'X'X'-$N_b$'-Y'Y'Y'-$N_b$'-Z'Z'Z'-$N_a$-$n_q$'5'     (IIId)

When the dsRNAi agent is represented by formula (IIIa), each $N_a$ independently represents an oligonucleotide sequence comprising 2-20, 2-15, or 2-10 modified nucleotides.

When the dsRNAi agent is represented by formula (IIIb), each $N_b$ independently represents an oligonucleotide sequence comprising 1-10, 1-7, 1-5, or 1-4 modified nucleotides. Each $N_a$ independently represents an oligonucleotide sequence comprising 2-20, 2-15, or 2-10 modified nucleotides.

When the dsRNAi agent is represented as formula (IIIc), each $N_b$, $N_b$' independently represents an oligonucleotide sequence comprising 0-10, 0-7, 0-10, 0-7, 0-5, 0-4, 0-2, or 0 modified nucleotides. Each $N_a$ independently represents an oligonucleotide sequence comprising 2-20, 2-15, or 2-10 modified nucleotides.

When the dsRNAi agent is represented as formula (IIId), each $N_b$, $N_b$' independently represents an oligonucleotide sequence comprising 0-10, 0-7, 0-10, 0-7, 0-5, 0-4, 0-2, or 0 modified nucleotides. Each $N_a$, $N_a$' independently represents an oligonucleotide sequence comprising 2-20, 2-15, or 2-10 modified nucleotides. Each of $N_a$, $N_a$', $N_b$, and $N_b$' independently comprises modifications of alternating pattern.

Each of X, Y, and Z in formulas (III), (IIIa), (IIIb), (IIIc), and (IIId) may be the same or different from each other.

When the dsRNAi agent is represented by formula (III), (IIIa), (IIIb), (IIIc), and (IIId), at least one of the Y nucleotides may form a base pair with one of the Y' nucleotides. Alternatively, at least two of the Y nucleotides form base pairs with the corresponding Y' nucleotides; or all three of the Y nucleotides all form base pairs with the corresponding Y' nucleotides.

When the dsRNAi agent is represented by formula (IIIb) or (IIId), at least one of the Z nucleotides may form a base pair with one of the Z' nucleotides. Alternatively, at least two of the Z nucleotides form base pairs with the corresponding Z' nucleotides; or all three of the Z nucleotides all form base pairs with the corresponding Z' nucleotides.

When the dsRNAi agent is represented as formula (IIIc) or (IIId), at least one of the X nucleotides may form a base pair with one of the X' nucleotides. Alternatively, at least two of the X nucleotides form base pairs with the corresponding X' nucleotides; or all three of the X nucleotides all form base pairs with the corresponding X' nucleotides.

In certain embodiments, the modification on the Y nucleotide is different than the modification on the Y' nucleotide, the modification on the Z nucleotide is different than the modification on the Z' nucleotide, or the modification on the X nucleotide is different than the modification on the X' nucleotide.

In certain embodiments, when the dsRNAi agent is represented by formula (IIId), the $N_a$ modifications are 2'-O-methyl or 2'-fluoro modifications. In other embodiments, when the RNAi agent is represented by formula (IIId), the $N_a$ modifications are 2'-O-methyl or 2'-fluoro modifications and $n_p$'>0 and at least one $n_p$' is linked to a neighboring nucleotide a via phosphorothioate linkage. In yet other embodiments, when the RNAi agent is represented by formula (IIId), the $N_a$ modifications are 2'-O-methyl or 2'-fluoro modifications, $n_p$'>0 and at least one $n_p$' is linked to a neighboring nucleotide via phosphorothioate linkage, and the sense strand is conjugated to one or more GalNAc derivatives attached through a bivalent or trivalent branched linker (described below). In other embodiments, when the RNAi agent is represented by formula (IIId), the $N_a$ modifications are 2'-O-methyl or 2'-fluoro modifications, $n_p$'>0 and at least one $n_p$' is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In some embodiments, when the dsRNAi agent is represented by formula (IIIa), the $N_a$ modifications are 2'-O-methyl or 2'-fluoro modifications, $n_p$'≥0 and at least one $n_p$' is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In some embodiments, the dsRNAi agent is a multimer containing at least two duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In some embodiments, the dsRNAi agent is a multimer containing three, four, five, six, or more duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, two dsRNAi agents represented by at least one of formulas (III), (IIIa), (IIIb), (IIIc), and (IIId) are linked to each other at the 5' end, and one or both of the 3' ends, and are optionally conjugated to a ligand. Each of the agents can target the same gene or two different genes; or each of the agents can target same gene at two different target sites.

In certain embodiments, an RNAi agent of the invention may contain a low number of nucleotides containing a 2'-fluoro modification, e.g., 10 or fewer nucleotides with 2'-fluoro modification. For example, the RNAi agent may contain 10, 9, 8, 7, 6, 5, 4, 3, 2, 1 or 0 nucleotides with a 2'-fluoro modification. In a specific embodiment, the RNAi agent of the invention contains 10 nucleotides with a 2'-fluoro modification, e.g., 4 nucleotides with a 2'-fluoro modification in the sense strand and 6 nucleotides with a 2'-fluoro modification in the antisense strand. In another specific embodiment, the RNAi agent of the invention contains 6 nucleotides with a 2'-fluoro modification, e.g., 4 nucleotides with a 2'-fluoro modification in the sense strand and 2 nucleotides with a 2'-fluoro modification in the antisense strand.

In other embodiments, an RNAi agent of the invention may contain an ultra low number of nucleotides containing a 2'-fluoro modification, e.g., 2 or fewer nucleotides containing a 2'-fluoro modification. For example, the RNAi agent may contain 2, 1 of 0 nucleotides with a 2'-fluoro modification. In a specific embodiment, the RNAi agent may contain 2 nucleotides with a 2'-fluoro modification, e.g., 0 nucleotides with a 2-fluoro modification in the sense strand and 2 nucleotides with a 2'-fluoro modification in the antisense strand.

Various publications describe multimeric iRNAs that can be used in the methods of the invention. Such publications include WO2007/091269, U.S. Pat. No. 7,858,769, WO2010/141511, WO2007/117686, WO2009/014887, and WO2011/031520 the entire contents of each of which are hereby incorporated herein by reference.

As described in more detail below, the iRNA that contains conjugations of one or more carbohydrate moieties to an iRNA can optimize one or more properties of the iRNA. In many cases, the carbohydrate moiety will be attached to a modified subunit of the iRNA. For example, the ribose sugar of one or more ribonucleotide subunits of a iRNA can be replaced with another moiety, e.g., a non-carbohydrate (preferably cyclic) carrier to which is attached a carbohydrate ligand. A ribonucleotide subunit in which the ribose sugar of the subunit has been so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The ligand may be attached to the polynucleotide via a carrier. The carriers include (i) at least one "backbone attachment point," preferably two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP) in some embodiments refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide, or polysaccharide. Optionally, the selected moiety is connected by an intervening tether to the cyclic carrier. Thus, the cyclic carrier will often include a functional group, e.g., an amino group, or generally, provide a bond, that is suitable for incorporation or tethering of another chemical entity, e.g., a ligand to the constituent ring.

The iRNA may be conjugated to a ligand via a carrier, wherein the carrier can be cyclic group or acyclic group; preferably, the cyclic group is selected from pyrrolidinyl, pyrazolinyl, pyrazolidinyl, imidazolinyl, imidazolidinyl, piperidinyl, piperazinyl, [1,3]dioxolane, oxazolidinyl, isoxazolidinyl, morpholinyl, thiazolidinyl, isothiazolidinyl, quinoxalinyl, pyridazinonyl, tetrahydrofuryl, and decalin; preferably, the acyclic group is a serinol backbone or diethanolamine backbone.

In another embodiment of the invention, an iRNA agent comprises a sense strand and an antisense strand, each strand having 14 to 40 nucleotides. The RNAi agent may be represented by formula (L):

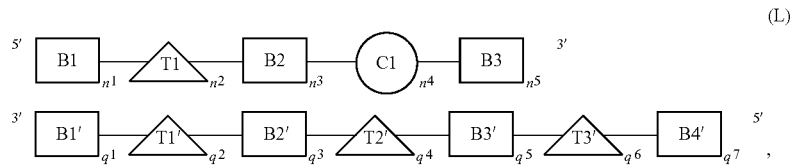

(L)

In formula (L), B1, B2, B3, B1', B2', B3', and B4' each are independently a nucleotide containing a modification selected from the group consisting of 2'-O-alkyl, 2'-substituted alkoxy, 2'-substituted alkyl, 2'-halo, ENA, and BNA/LNA. In one embodiment, B1, B2, B3, B1', B2', B3', and B4' each contain 2'-OMe modifications. In one embodiment, B1, B2, B3, B1', B2', B3', and B4' each contain 2'-OMe or 2'-F modifications. In one embodiment, at least one of B1, B2, B3, B1', B2', B3', and B4' contain 2'-O—N-methylacetamido (2'-O-NMA) modification.

C1 is a thermally destabilizing nucleotide placed at a site opposite to the seed region of the antisense strand (i.e., at positions 2-8 of the 5'-end of the antisense strand). For example, C1 is at a position of the sense strand that pairs with a nucleotide at positions 2-8 of the 5'-end of the antisense strand. In one example, C1 is at position 15 from the 5'-end of the sense strand. C1 nucleotide bears the thermally destabilizing modification which can include abasic modification; mismatch with the opposing nucleotide in the duplex; and sugar modification such as 2'-deoxy modification or acyclic nucleotide e.g., unlocked nucleic acids (UNA) or glycerol nucleic acid (GNA). In one embodiment, C1 has thermally destabilizing modification selected from the group consisting of: i) mismatch with the opposing nucleotide in the antisense strand; ii) abasic modification selected from the group consisting of:

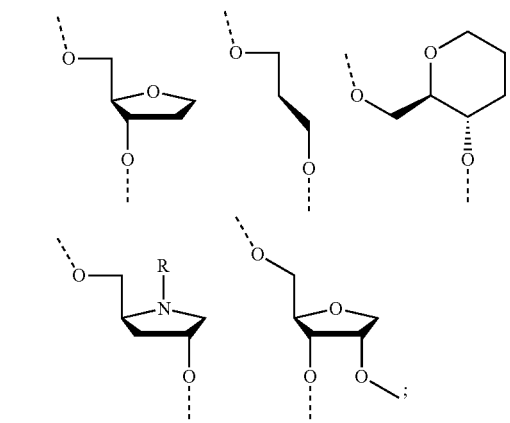

and iii) sugar modification selected from the group consisting of:

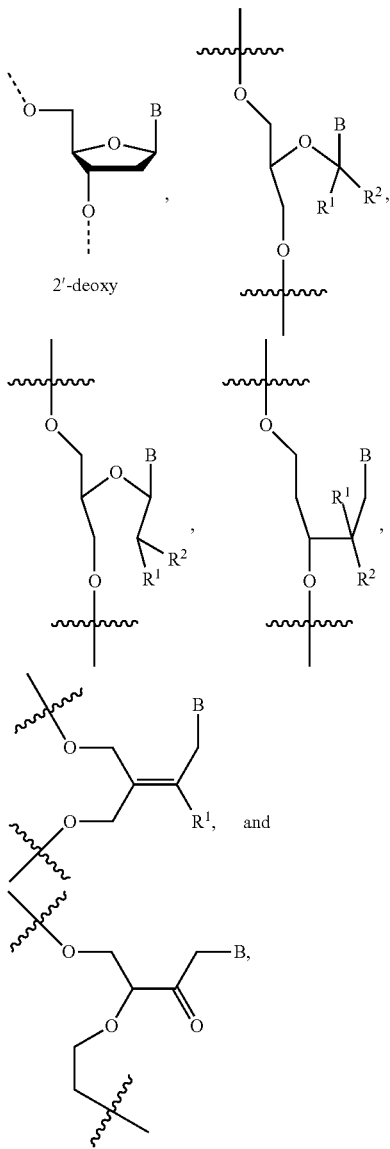

wherein B is a modified or unmodified nucleobase, $R^1$ and $R^2$ independently are H, halogen, $OR_3$, or alkyl; and $R_3$ is H, alkyl, cycloalkyl, aryl, aralkyl, heteroaryl or sugar. In one embodiment, the thermally destabilizing modification in C1 is a mismatch selected from the group consisting of G:G, G:A, G:U, G:T, A:A, A:C, C:C, C:U, C:T, U:U, T:T, and U:T; and optionally, at least one nucleobase in the mismatch pair is a 2'-deoxy nucleobase. In one example, the thermally destabilizing modification in C1 is GNA or

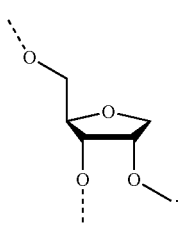

T1, T1', T2', and T3' each independently represent a nucleotide comprising a modification providing the nucleotide a steric bulk that is less or equal to the steric bulk of a 2'-OMe modification. A steric bulk refers to the sum of steric effects of a modification. Methods for determining steric effects of a modification of a nucleotide are known to one skilled in the art. The modification can be at the 2' position of a ribose sugar of the nucleotide, or a modification to a non-ribose nucleotide, acyclic nucleotide, or the backbone of the nucleotide that is similar or equivalent to the 2' position of the ribose sugar, and provides the nucleotide a steric bulk that is less than or equal to the steric bulk of a 2'-OMe modification. For example, T1, T1', T2', and T3' are each independently selected from DNA, RNA, LNA, 2'-F, and 2'-F-5'-methyl. In one embodiment, T1 is DNA. In one embodiment, T1' is DNA, RNA or LNA. In one embodiment, T2' is DNA or RNA. In one embodiment, T3' is DNA or RNA.

$n^1$, $n^3$, and q are independently 4 to 15 nucleotides in length.

$n^5$, $q^3$, and $q^7$ are independently 1-6 nucleotide(s) in length.

$n^4$, $q^2$, and $q^6$ are independently 1-3 nucleotide(s) in length; alternatively, $n^4$ is 0.

$q^5$ is independently 0-10 nucleotide(s) in length.

$n^2$ and $q^4$ are independently 0-3 nucleotide(s) in length. Alternatively, $n^4$ is 0-3 nucleotide(s) in length.

In one embodiment, $n^4$ can be 0. In one example, $n^4$ is 0, and $q^2$ and $q^6$ are 1. In another example, $n^4$ is 0, and $q^2$ and $q^6$ are 1, with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, $n^4$, $q^2$, and $q^6$ are each 1.

In one embodiment, $n^2$, $n^4$, $q^2$, $q^4$, and $q^6$ are each 1.

In one embodiment, C1 is at position 14-17 of the 5'-end of the sense strand, when the sense strand is 19-22 nucleotides in length, and $n^4$ is 1. In one embodiment, C1 is at position 15 of the 5'-end of the sense strand.

In one embodiment, T3' starts at position 2 from the 5' end of the antisense strand. In one example, T3' is at position 2 from the 5' end of the antisense strand and $q^6$ is equal to 1.

In one embodiment, T1' starts at position 14 from the 5' end of the antisense strand. In one example, T1' is at position 14 from the 5' end of the antisense strand and $q^2$ is equal to 1.

In an exemplary embodiment, T3' starts from position 2 from the 5' end of the antisense strand and T1' starts from position 14 from the 5' end of the antisense strand. In one example, T3' starts from position 2 from the 5' end of the antisense strand and $q^6$ is equal to 1 and T1' starts from position 14 from the 5' end of the antisense strand and $q^2$ is equal to 1.

In one embodiment, T1' and T3' are separated by 11 nucleotides in length (i.e. not counting the T1' and T3' nucleotides).

In one embodiment, T1' is at position 14 from the 5' end of the antisense strand. In one example, T1' is at position 14 from the 5' end of the antisense strand and $q^2$ is equal to 1, and the modification at the 2' position or positions in a non-ribose, acyclic or backbone that provide less steric bulk than a 2'-OMe ribose.

In one embodiment, T3' is at position 2 from the 5' end of the antisense strand. In one example, T3' is at position 2 from the 5' end of the antisense strand and $q^6$ is equal to 1, and the modification at the 2' position or positions in a non-ribose, acyclic or backbone that provide less than or equal to steric bulk than a 2'-OMe ribose.

In one embodiment, T1 is at the cleavage site of the sense strand. In one example, T1 is at position 11 from the 5' end of the sense strand, when the sense strand is 19-22 nucleotides in length, and $n^2$ is 1. In an exemplary embodiment, T1 is at the cleavage site of the sense strand at position 11 from the 5' end of the sense strand, when the sense strand is 19-22 nucleotides in length, and $n^2$ is 1, In one embodiment, T2' starts at position 6 from the 5' end of the antisense strand. In one example, T2' is at positions 6-10 from the 5' end of the antisense strand, and $q^4$ is 1.

In an exemplary embodiment, T1 is at the cleavage site of the sense strand, for instance, at position 11 from the 5' end of the sense strand, when the sense strand is 19-22 nucleotides in length, and $n^2$ is 1; T1' is at position 14 from the 5' end of the antisense strand, and $q^2$ is equal to 1, and the modification to T1' is at the 2' position of a ribose sugar or at positions in a non-ribose, acyclic or backbone that provide less steric bulk than a 2'-OMe ribose; T2' is at positions 6-10 from the 5' end of the antisense strand, and $q^4$ is 1; and T3' is at position 2 from the 5' end of the antisense strand, and $q^6$ is equal to 1, and the modification to T3' is at the 2' position or at positions in a non-ribose, acyclic or backbone that provide less than or equal to steric bulk than a 2'-OMe ribose.

In one embodiment, T2' starts at position 8 from the 5' end of the antisense strand. In one example, T2' starts at position 8 from the 5' end of the antisense strand, and $q^4$ is 2.

In one embodiment, T2' starts at position 9 from the 5' end of the antisense strand. In one example, T2' is at position 9 from the 5' end of the antisense strand, and $q^4$ is 1.

In one embodiment, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 6, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 7, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1.

In one embodiment, B1 is 2'-OMe or 2'-F, $n^1$ is 6, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 7, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 5, T2' is 2'-F, $q^4$ is 1, B3' is 2'-OMe or 2'-F, $q^5$ is 5, T3' is 2'-F, $q^6$ is 1, B4' is 2'-OMe, and $q^7$ is 1; optionally with at least 2 additional TT at the 3'-end of the antisense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 5, T2' is 2'-F, $q^4$ is 1, B3' is 2'-OMe or 2'-F, $q^5$ is 5, T3' is 2'-F, $q^6$ is 1, B4' is 2'-OMe, and $q^7$ is 1; optionally with at least 2 additional TT at the 3'-end of the antisense strand; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within positions 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

The RNAi agent can comprise a phosphorus-containing group at the 5'-end of the sense strand or antisense strand. The 5'-end phosphorus-containing group can be 5'-end phosphate (5'-P), 5'-end phosphorothioate (5'-PS), 5'-end phosphorodithioate (5'-PS$_2$), 5'-end vinylphosphonate (5'-VP), 5'-end methylphosphonate (MePhos), or 5'-deoxy-5'-C-malonyl

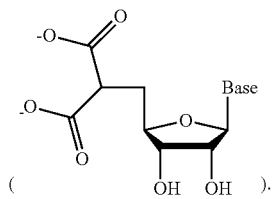

When the 5'-end phosphorus-containing group is 5'-end vinylphosphonate (5'-VP), the 5'-VP can be either 5'-E-VP isomer (i.e., trans-vinylphosphate,

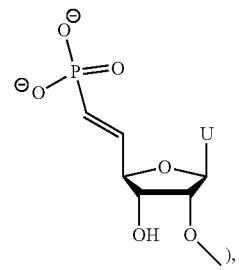

5'-Z-VP isomer (i.e., cis-vinylphosphate,

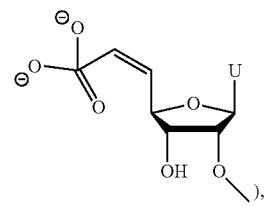

or mixtures thereof.

In one embodiment, the RNAi agent comprises a phosphorus-containing group at the 5'-end of the sense strand. In one embodiment, the RNAi agent comprises a phosphorus-containing group at the 5'-end of the antisense strand.

In one embodiment, the RNAi agent comprises a 5'-P. In one embodiment, the RNAi agent comprises a 5'-P in the antisense strand.

In one embodiment, the RNAi agent comprises a 5'-PS. In one embodiment, the RNAi agent comprises a 5'-PS in the antisense strand.

In one embodiment, the RNAi agent comprises a 5'-VP. In one embodiment, the RNAi agent comprises a 5'-VP in the antisense strand. In one embodiment, the RNAi agent comprises a 5'-E-VP in the antisense strand. In one embodiment, the RNAi agent comprises a 5'-Z-VP in the antisense strand.

In one embodiment, the RNAi agent comprises a 5'-PS$_2$. In one embodiment, the RNAi agent comprises a 5'-PS$_2$ in the antisense strand.

In one embodiment, the RNAi agent comprises a 5'-PS$_2$. In one embodiment, the RNAi agent comprises a 5'-deoxy-5'-C-malonyl in the antisense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-$PS_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-$PS_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The dsRNA agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-$PS_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The dsRNAi RNA agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP (e.g., a 5'-E-VP, 5'-Z-VP, or combination thereof), and a targeting ligand.

In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-$PS_2$ and a targeting ligand. In one embodiment, the 5'-$PS_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-VP (e.g., a 5'-E-VP, 5'-Z-VP, or combination thereof) and a targeting ligand. In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-$PS_2$ and a targeting ligand. In one embodiment, the 5'-$PS_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP (e.g., a 5'-E-VP, 5'-Z-VP, or combination thereof) and a targeting ligand. In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$ and a targeting ligand. In one embodiment, the 5'-PS$_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP (e.g., a 5'-E-VP, 5'-Z-VP, or combination thereof) and a targeting ligand. In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$ and a targeting ligand. In one embodiment, the 5'-PS$_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In a particular embodiment, an RNAi agent of the present invention comprises:
 (a) a sense strand having:
  (i) a length of 21 nucleotides;
  (ii) an ASGPR ligand attached to the 3'-end, wherein said ASGPR ligand comprises three GalNAc derivatives attached through a trivalent branched linker; and
  (iii) 2'-F modifications at positions 1, 3, 5, 7, 9 to 11, 13, 17, 19, and 21, and 2'-OMe modifications at positions 2, 4, 6, 8, 12, 14 to 16, 18, and 20 (counting from the 5' end);
 and
 (b) an antisense strand having:
  (i) a length of 23 nucleotides;
  (ii) 2'-OMe modifications at positions 1, 3, 5, 9, 11 to 13, 15, 17, 19, 21, and 23, and 2'F modifications at positions 2, 4, 6 to 8, 10, 14, 16, 18, 20, and 22 (counting from the 5' end); and
  (iii) phosphorothioate internucleotide linkages between nucleotide positions 21 and 22, and between nucleotide positions 22 and 23 (counting from the 5' end);
 wherein the dsRNA agents have a two nucleotide overhang at the 3'-end of the antisense strand, and a blunt end at the 5'-end of the antisense strand.

In another particular embodiment, an RNAi agent of the present invention comprises:
 (a) a sense strand having:
  (i) a length of 21 nucleotides;
  (ii) an ASGPR ligand attached to the 3'-end, wherein said ASGPR ligand comprises three GalNAc derivatives attached through a trivalent branched linker;
  (iii) 2'-F modifications at positions 1, 3, 5, 7, 9 to 11, 13, 15, 17, 19, and 21, and 2'-OMe modifications at positions 2, 4, 6, 8, 12, 14, 16, 18, and 20 (counting from the 5' end); and
  (iv) phosphorothioate internucleotide linkages between nucleotide positions 1 and 2, and between nucleotide positions 2 and 3 (counting from the 5' end);
 and
 (b) an antisense strand having:
  (i) a length of 23 nucleotides;
  (ii) 2'-OMe modifications at positions 1, 3, 5, 7, 9, 11 to 13, 15, 17, 19, and 21 to 23, and 2'F modifications at positions 2, 4, 6, 8, 10, 14, 16, 18, and 20 (counting from the 5' end); and
  (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
 wherein the RNAi agents have a two nucleotide overhang at the 3'-end of the antisense strand, and a blunt end at the 5'-end of the antisense strand.

In another particular embodiment, a RNAi agent of the present invention comprises:
 (a) a sense strand having:
  (i) a length of 21 nucleotides;
  (ii) an ASGPR ligand attached to the 3'-end, wherein said ASGPR ligand comprises three GalNAc derivatives attached through a trivalent branched linker;
  (iii) 2'-OMe modifications at positions 1 to 6, 8, 10, and 12 to 21, 2'-F modifications at positions 7, and 9, and a deoxy-nucleotide (e.g. dT) at position 11 (counting from the 5' end); and
  (iv) phosphorothioate internucleotide linkages between nucleotide positions 1 and 2, and between nucleotide positions 2 and 3 (counting from the 5' end);
 and
 (b) an antisense strand having:
  (i) a length of 23 nucleotides;
  (ii) 2'-OMe modifications at positions 1, 3, 7, 9, 11, 13, 15, 17, and 19 to 23, and 2'-F modifications at positions 2, 4 to 6, 8, 10, 12, 14, 16, and 18 (counting from the 5' end); and
  (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
 wherein the RNAi agents have a two nucleotide overhang at the 3'-end of the antisense strand, and a blunt end at the 5'-end of the antisense strand.

In another particular embodiment, a RNAi agent of the present invention comprises:
 (a) a sense strand having:
  (i) a length of 21 nucleotides;
  (ii) an ASGPR ligand attached to the 3'-end, wherein said ASGPR ligand comprises three GalNAc derivatives attached through a trivalent branched linker;
  (iii) 2'-OMe modifications at positions 1 to 6, 8, 10, 12, 14, and 16 to 21, and 2'-F modifications at positions 7, 9, 11, 13, and 15; and
  (iv) phosphorothioate internucleotide linkages between nucleotide positions 1 and 2, and between nucleotide positions 2 and 3 (counting from the 5' end);
 and
 (b) an antisense strand having:
  (i) a length of 23 nucleotides;
  (ii) 2'-OMe modifications at positions 1, 5, 7, 9, 11, 13, 15, 17, 19, and 21 to 23, and 2'-F modifications at positions 2 to 4, 6, 8, 10, 12, 14, 16, 18, and 20 (counting from the 5' end); and
  (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
 wherein the RNAi agents have a two nucleotide overhang at the 3'-end of the antisense strand, and a blunt end at the 5'-end of the antisense strand.

In another particular embodiment, a RNAi agent of the present invention comprises:
 (a) a sense strand having:
  (i) a length of 21 nucleotides;
  (ii) an ASGPR ligand attached to the 3'-end, wherein said ASGPR ligand comprises three GalNAc derivatives attached through a trivalent branched linker;
  (iii) 2'-OMe modifications at positions 1 to 9, and 12 to 21, and 2'-F modifications at positions 10, and 11; and (iv) phosphorothioate internucleotide linkages between nucleotide positions 1 and 2, and between nucleotide positions 2 and 3 (counting from the 5' end);

and (b) an antisense strand having:
  (i) a length of 23 nucleotides;
  (ii) 2'-OMe modifications at positions 1, 3, 5, 7, 9, 11 to 13, 15, 17, 19, and 21 to 23, and 2'-F modifications at positions 2, 4, 6, 8, 10, 14, 16, 18, and 20 (counting from the 5' end); and
  (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:

(a) a sense strand having:
  (i) a length of 21 nucleotides;
  (ii) an ASGPR ligand attached to the 3'-end, wherein said ASGPR ligand comprises three GalNAc derivatives attached through a trivalent branched linker;
  (iii) 2'-F modifications at positions 1, 3, 5, 7, 9 to 11, and 13, and 2'-OMe modifications at positions 2, 4, 6, 8, 12, and 14 to 21; and
  (iv) phosphorothioate internucleotide linkages between nucleotide positions 1 and 2, and between nucleotide positions 2 and 3 (counting from the 5' end);

and (b) an antisense strand having:
  (i) a length of 23 nucleotides;
  (ii) 2'-OMe modifications at positions 1, 3, 5 to 7, 9, 11 to 13, 15, 17 to 19, and 21 to 23, and 2'-F modifications at positions 2, 4, 8, 10, 14, 16, and 20 (counting from the 5' end); and
  (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:

(a) a sense strand having:
  (i) a length of 21 nucleotides;
  (ii) an ASGPR ligand attached to the 3'-end, wherein said ASGPR ligand comprises three GalNAc derivatives attached through a trivalent branched linker;
  (iii) 2'-OMe modifications at positions 1, 2, 4, 6, 8, 12, 14, 15, 17, and 19 to 21, and 2'-F modifications at positions 3, 5, 7, 9 to 11, 13, 16, and 18; and
  (iv) phosphorothioate internucleotide linkages between nucleotide positions 1 and 2, and between nucleotide positions 2 and 3 (counting from the 5' end);

and (b) an antisense strand having:
  (i) a length of 25 nucleotides;
  (ii) 2'-OMe modifications at positions 1, 4, 6, 7, 9, 11 to 13, 15, 17, and 19 to 23, 2'-F modifications at positions 2, 3, 5, 8, 10, 14, 16, and 18, and desoxy-nucleotides (e.g. dT) at positions 24 and 25 (counting from the 5' end); and
  (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a four nucleotide overhang at the 3'-end of the antisense strand, and a blunt end at the 5'-end of the antisense strand.

In another particular embodiment, a RNAi agent of the present invention comprises:

(a) a sense strand having:
  (i) a length of 21 nucleotides;
  (ii) an ASGPR ligand attached to the 3'-end, wherein said ASGPR ligand comprises three GalNAc derivatives attached through a trivalent branched linker;
  (iii) 2'-OMe modifications at positions 1 to 6, 8, and 12 to 21, and 2'-F modifications at positions 7, and 9 to 11; and
  (iv) phosphorothioate internucleotide linkages between nucleotide positions 1 and 2, and between nucleotide positions 2 and 3 (counting from the 5' end);

and (b) an antisense strand having:
  (i) a length of 23 nucleotides;
  (ii) 2'-OMe modifications at positions 1, 3 to 5, 7, 8, 10 to 13, 15, and 17 to 23, and 2'-F modifications at positions 2, 6, 9, 14, and 16 (counting from the 5' end); and
  (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:

(a) a sense strand having:
  (i) a length of 21 nucleotides;
  (ii) an ASGPR ligand attached to the 3'-end, wherein said ASGPR ligand comprises three GalNAc derivatives attached through a trivalent branched linker;
  (iii) 2'-OMe modifications at positions 1 to 6, 8, and 12 to 21, and 2'-F modifications at positions 7, and 9 to 11; and
  (iv) phosphorothioate internucleotide linkages between nucleotide positions 1 and 2, and between nucleotide positions 2 and 3 (counting from the 5' end);

and (b) an antisense strand having:
  (i) a length of 23 nucleotides;
  (ii) 2'-OMe modifications at positions 1, 3 to 5, 7, 10 to 13, 15, and 17 to 23, and 2'-F modifications at positions 2, 6, 8, 9, 14, and 16 (counting from the 5' end); and
  (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
(i) a length of 19 nucleotides;
(ii) an ASGPR ligand attached to the 3'-end, wherein said ASGPR ligand comprises three GalNAc derivatives attached through a trivalent branched linker;
(iii) 2'-OMe modifications at positions 1 to 4, 6, and 10 to 19, and 2'-F modifications at positions 5, and 7 to 9; and
(iv) phosphorothioate internucleotide linkages between nucleotide positions 1 and 2, and between nucleotide positions 2 and 3 (counting from the 5' end);
and
(b) an antisense strand having:
(i) a length of 21 nucleotides;
(ii) 2'-OMe modifications at positions 1, 3 to 5, 7, 10 to 13, 15, and 17 to 21, and 2'-F modifications at positions 2, 6, 8, 9, 14, and 16 (counting from the 5' end); and
(iii) phosphorothioate internucleotide linkages between nucleotide positions 1 and 2, between nucleotide positions 2 and 3, between nucleotide positions 19 and 20, and between nucleotide positions 20 and 21 (counting from the 5' end);
wherein the RNAi agents have a two nucleotide overhang at the 3'-end of the antisense strand, and a blunt end at the 5'-end of the antisense strand.

In certain embodiments, the iRNA for use in the methods of the invention is an agent selected from agents listed in Tables 2-9. These agents may further comprise a ligand.

III. iRNAs Conjugated to Ligands

Another modification of the RNA of an iRNA of the invention involves chemically linking to the iRNA one or more ligands, moieties or conjugates that enhance the activity, cellular distribution, or cellular uptake of the iRNA e.g., into a cell. Such moieties include but are not limited to lipid moieties such as a cholesterol moiety (Letsinger et al., *Proc. Natl. Acad. Sci. USA,* 1989, 86: 6553-6556). In other embodiments, the ligand is cholic acid (Manoharan et al., *Biorg. Med. Chem. Let.,* 1994, 4:1053-1060), athioether, e.g., beryl-S-tritylthiol (Manoharan et al., *Ann. N. Y. Acad. Sci.,* 1992, 660:306-309; Manoharan et al., *Biorg. Med. Chem. Let.,* 1993, 3:2765-2770), a thiocholesterol (Oberhauser et al., *Nucl. Acids Res.,* 1992, 20:533-538), an aliphatic chain, e.g., dodecandiol or undecyl residues (Saison-Behmoaras et al., *EMBO J,* 1991, 10:1111-1118; Kabanov et al., *FEBS Lett.,* 1990, 259:327-330; Svinarchuk et al., *Biochimie,* 1993, 75:49-54), a phospholipid, e.g., di-hexadecyl-rac-glycerol or triethyl-ammonium 1,2-di-O-hexadecyl-rac-glycero-3-phosphonate (Manoharan et al., *Tetrahedron Lett.,* 1995, 36:3651-3654; Shea et al., *Nucl. Acids Res.,* 1990, 18:3777-3783), a polyamine or a polyethylene glycol chain (Manoharan et al., *Nucleosides & Nucleotides,* 1995, 14:969-973), or adamantane acetic acid (Manoharan et al., *Tetrahedron Lett.,* 1995, 36:3651-3654), a palmityl moiety (Mishra et al., *Biochim. Biophys. Acta,* 1995, 1264:229-237), or an octadecylamine or hexylaminocarbonyloxycholesterol moiety (Crooke et al., *J. Pharmacol. Exp. Ther.,* 1996, 277:923-937).

In certain embodiments, a ligand alters the distribution, targeting, or lifetime of an iRNA agent into which it is incorporated. In preferred embodiments a ligand provides an enhanced affinity for a selected target, e.g., molecule, cell or cell type, compartment, e.g., a cellular or organ compartment, tissue, organ or region of the body, as, e.g., compared to a species absent such a ligand. Preferred ligands do not take part in duplex pairing in a duplexed nucleic acid.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin, N-acetylglucosamine, N-acetylgalactosamine, or hyaluronic acid); or a lipid. The ligand can also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly (2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-glucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, vitamin A, biotin, or an RGD peptide or RGD peptide mimetic. In certain embodiments, the ligand is a multivalent galactose, e.g., an N-acetyl-galactosamine.

Other examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g., cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid, O3-(oleoyl) lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, $[MPEG]_2$, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a hepatic cell. Ligands can also include hormones and hormone receptors. They can also include non-peptidic species, such as lipids, lectins, carbohydrates, vitamins, cofactors, multivalent lactose, multivalent galactose, N-acetyl-galactosamine, N-acetyl-glucosamine multivalent mannose, or multivalent fucose. The ligand can be, for example, a lipopolysaccharide, an activator of p38 MAP kinase, or an activator of NF-κB.

The ligand can be a substance, e.g., a drug, which can increase the uptake of the iRNA agent into the cell, for example, by disrupting the cell's cytoskeleton, e.g., by disrupting the cell's microtubules, microfilaments, or intermediate filaments. The drug can be, for example, taxol, vincristine, vinblastine, cytochalasin, nocodazole, japlakinolide, latrunculin A, phalloidin, swinholide A, indanocine, or myoservin.

In some embodiments, a ligand attached to an iRNA as described herein acts as a pharmacokinetic modulator (PK modulator). PK modulators include lipophiles, bile acids, steroids, phospholipid analogues, peptides, protein binding agents, PEG, vitamins, etc. Exemplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin. Oligonucleotides that comprise a number of phosphorothioate linkages are also known to bind to serum protein, thus short oligonucleotides, e.g., oligonucleotides of about 5 bases, 10 bases, 15 bases, or 20 bases, comprising multiple of phosphorothioate linkages in the backbone are also amenable to the present invention as ligands (e.g. as PK modulating ligands). In addition, aptamers that bind serum components (e.g. serum proteins) are also suitable for use as PK modulating ligands in the embodiments described herein.

Ligand-conjugated iRNAs of the invention may be synthesized by the use of an oligonucleotide that bears a pendant reactive functionality, such as that derived from the attachment of a linking molecule onto the oligonucleotide (described below). This reactive oligonucleotide may be reacted directly with commercially-available ligands, ligands that are synthesized bearing any of a variety of protecting groups, or ligands that have a linking moiety attached thereto.

The oligonucleotides used in the conjugates of the present invention may be conveniently and routinely made through the well-known technique of solid-phase synthesis. Equipment for such synthesis is sold by several vendors including, for example, Applied Biosystems® (Foster City, Calif.). Any other methods for such synthesis known in the art may additionally or alternatively be employed. It is also known to use similar techniques to prepare other oligonucleotides, such as the phosphorothioates and alkylated derivatives.

In the ligand-conjugated iRNAs and ligand-molecule bearing sequence-specific linked nucleosides of the present invention, the oligonucleotides and oligonucleosides may be assembled on a suitable DNA synthesizer utilizing standard nucleotide or nucleoside precursors, or nucleotide or nucleoside conjugate precursors that already bear the linking moiety, ligand-nucleotide or nucleoside-conjugate precursors that already bear the ligand molecule, or non-nucleoside ligand-bearing building blocks.

When using nucleotide-conjugate precursors that already bear a linking moiety, the synthesis of the sequence-specific linked nucleosides is typically completed, and the ligand molecule is then reacted with the linking moiety to form the ligand-conjugated oligonucleotide. In some embodiments, the oligonucleotides or linked nucleosides of the present invention are synthesized by an automated synthesizer using phosphoramidites derived from ligand-nucleoside conjugates in addition to the standard phosphoramidites and non-standard phosphoramidites that are commercially available and routinely used in oligonucleotide synthesis.

A. Lipid Conjugates

In certain embodiments, the ligand or conjugate is a lipid or lipid-based molecule. Such a lipid or lipid-based molecule preferably binds a serum protein, e.g., human serum albumin (HSA). An HSA binding ligand allows for distribution of the conjugate to a target tissue, e.g., a non-kidney target tissue of the body. For example, the target tissue can be the liver, including parenchymal cells of the liver. Other molecules that can bind HSA can also be used as ligands. For example, naproxen or aspirin can be used. A lipid or lipid-based ligand can (a) increase resistance to degradation of the conjugate, (b) increase targeting or transport into a target cell or cell membrane, or (c) can be used to adjust binding to a serum protein, e.g., HSA.

A lipid based ligand can be used to inhibit, e.g., control the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In certain embodiments, the lipid based ligand binds HSA. Preferably, it binds HSA with a sufficient affinity such that the conjugate will be preferably distributed to a non-kidney tissue. However, it is preferred that the affinity not be so strong that the HSA-ligand binding cannot be reversed.

In other embodiments, the lipid based ligand binds HSA weakly or not at all, such that the conjugate will be preferably distributed to the kidney. Other moieties that target to kidney cells can also be used in place of, or in addition to, the lipid based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include are B vitamin, e.g., folic acid, B12, riboflavin, biotin, pyridoxal or other vitamins or nutrients taken up by target cells such as liver cells. Also included are HSA and low density lipoprotein (LDL).

B. Cell Permeation Agents

In another aspect, the ligand is a cell-permeation agent, preferably a helical cell-permeation agent. Preferably, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. The helical agent is preferably an alpha-helical agent, which preferably has a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The attachment of peptide and peptidomimetics to iRNA agents can affect pharmacokinetic distribution of the iRNA, such as by enhancing cellular recognition and absorption. The peptide or peptidomimetic moiety can be about 5-50 amino acids long, e.g., about 5, 10, 15, 20, 25, 30, 35, 40, 45, or 50 amino acids long.

A peptide or peptidomimetic can be, for example, a cell permeation peptide, cationic peptide, amphipathic peptide, or hydrophobic peptide (e.g., consisting primarily of Tyr, Trp, or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO: 19). An RFGF analogue (e.g., amino acid sequence AALLPVL-LAAP (SEQ ID NO: 20) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO: 21) and the *Drosophila* Antennapedia protein (RQIKIWFQNRRMKWKK (SEQ ID NO: 22) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., Nature, 354:82-84, 1991). Examples of a peptide or peptidomimetic tethered to a dsRNA agent via an incorporated monomer unit for cell targeting purposes is an arginine-glycine-aspartic acid (RGD)-peptide, or RGD mimic. A peptide moiety can range in length from about 5 amino acids to about 40 amino acids. The peptide moieties can have a structural modification, such as to increase stability or direct conformational properties. Any of the structural modifications described below can be utilized.

An RGD peptide for use in the compositions and methods of the invention may be linear or cyclic, and may be modified, e.g., glycosylated or methylated, to facilitate targeting to a specific tissue(s). RGD-containing peptides and peptidiomimemtics may include D-amino acids, as well as synthetic RGD mimics. In addition to RGD, one can use other moieties that target the integrin ligand. Preferred conjugates of this ligand target PECAM-1 or VEGF.

A "cell permeation peptide" is capable of permeating a cell, e.g., a microbial cell, such as a bacterial or fungal cell, or a mammalian cell, such as a human cell. A microbial cell-permeating peptide can be, for example, an α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003).

C. Carbohydrate Conjugates

In some embodiments of the compositions and methods of the invention, an iRNA further comprises a carbohydrate. The carbohydrate conjugated iRNA is advantageous for the in vivo delivery of nucleic acids, as well as compositions suitable for in vivo therapeutic use, as described herein. As used herein, "carbohydrate" refers to a compound which is either a carbohydrate per se made up of one or more monosaccharide units having at least 6 carbon atoms (which can be linear, branched or cyclic) with an oxygen, nitrogen or sulfur atom bonded to each carbon atom; or a compound having as a part thereof a carbohydrate moiety made up of one or more monosaccharide units each having at least six carbon atoms (which can be linear, branched or cyclic), with an oxygen, nitrogen or sulfur atom bonded to each carbon atom. Representative carbohydrates include the sugars (mono-, di-, tri-, and oligosaccharides containing from about 4, 5, 6, 7, 8, or 9 monosaccharide units), and polysaccharides such as starches, glycogen, cellulose and polysaccharide gums. Specific monosaccharides include C5 and above (e.g., C5, C6, C7, or C8) sugars; di- and trisaccharides include sugars having two or three monosaccharide units (e.g., C5, C6, C7, or C8).

In certain embodiments, a carbohydrate conjugate for use in the compositions and methods of the invention is a monosaccharide.

In one embodiment, a carbohydrate conjugate for use in the compositions and methods of the invention is selected from the group consisting of:

Formula II

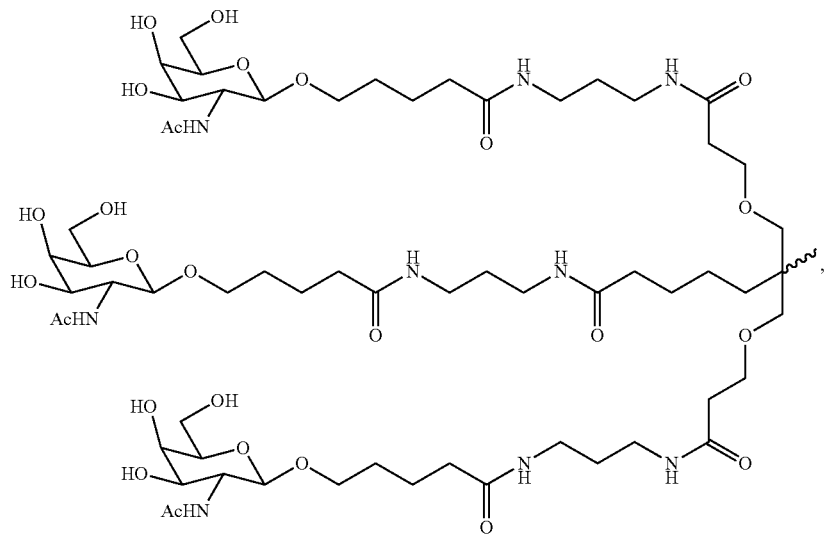

-continued
Formula III
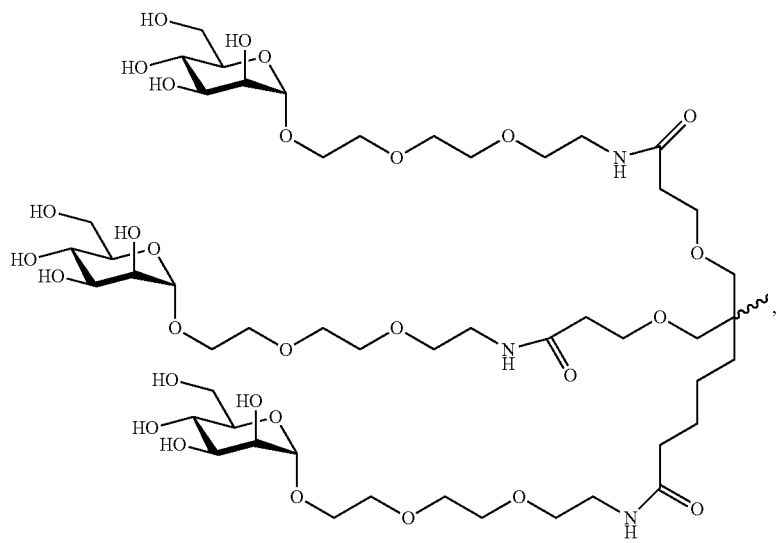
Formula IV
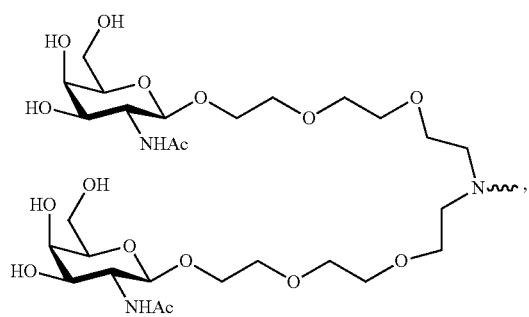
Formula V
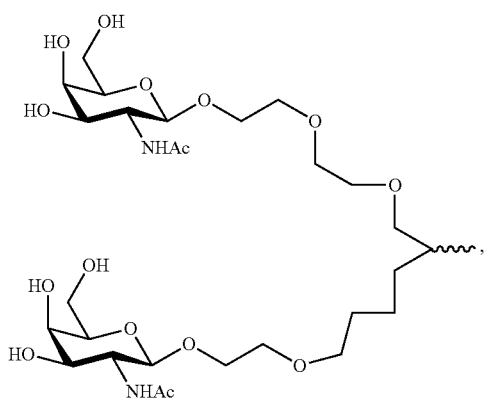
Formula VI
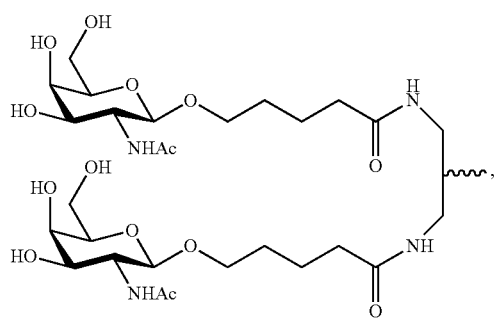
Formula VII
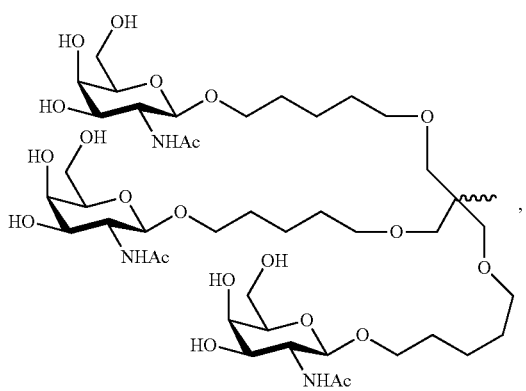
Formula VIII
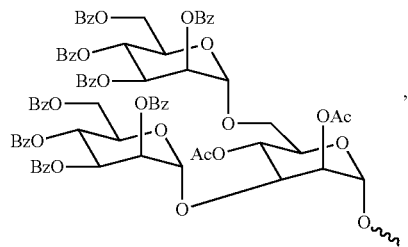

Formula IX
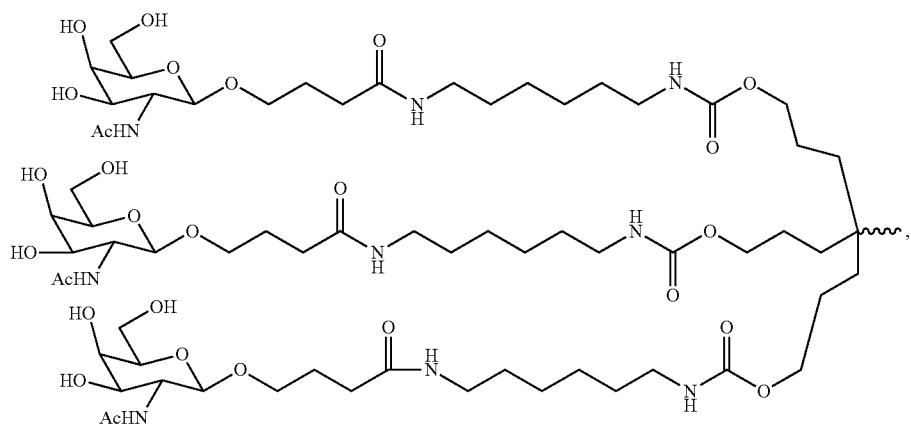
Formula X
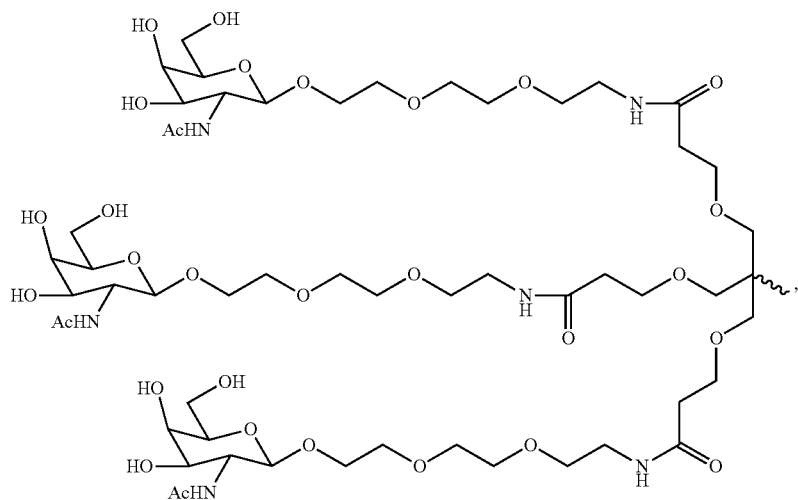
Formula XI
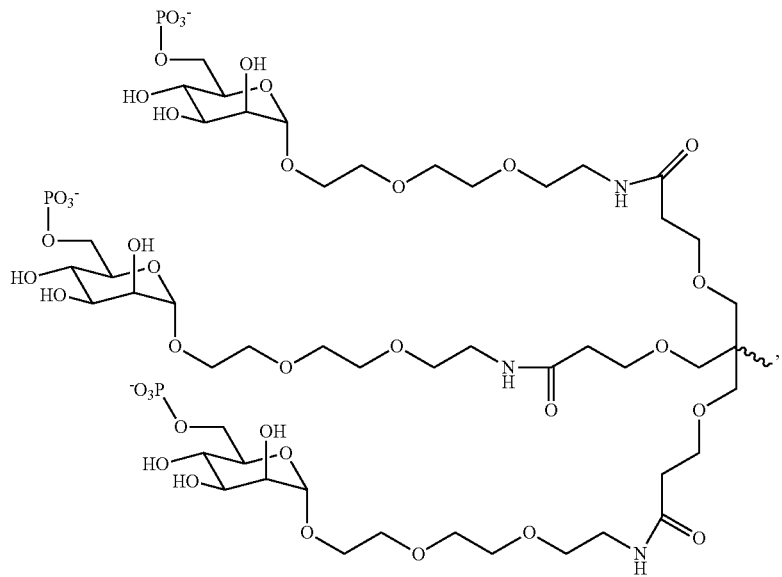

Formula XII
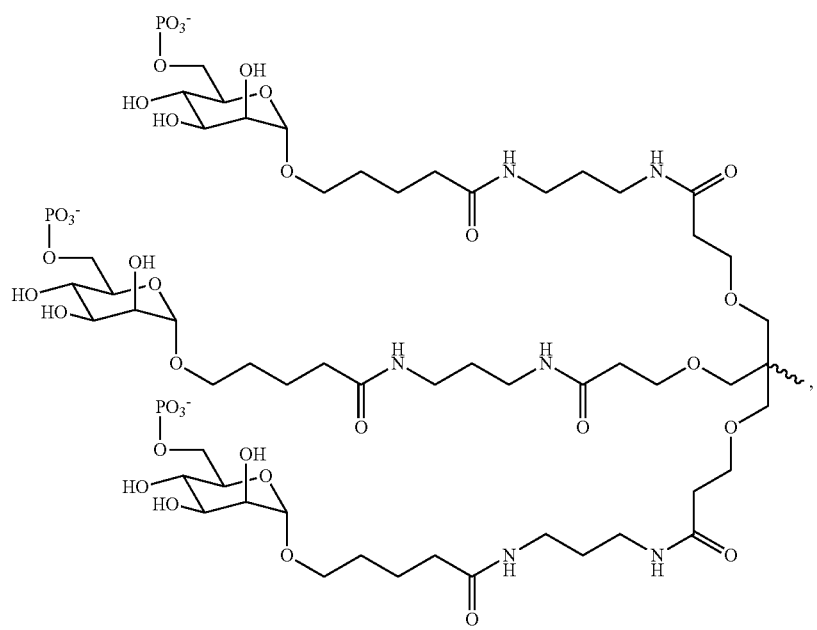
Formula XIII
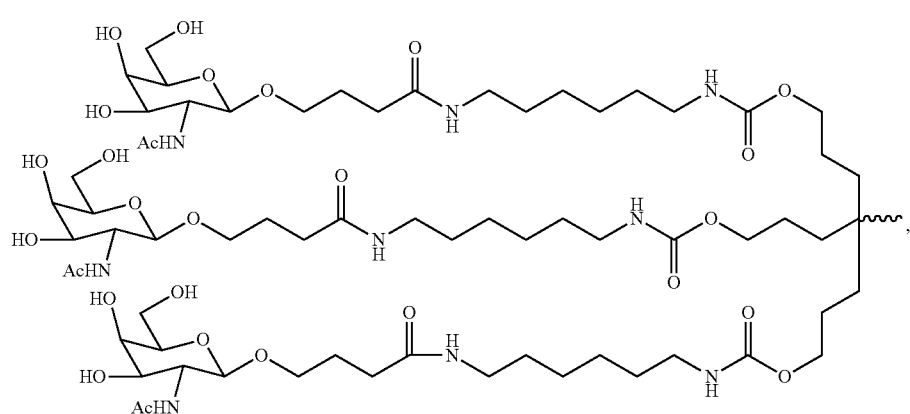
Formula XIV
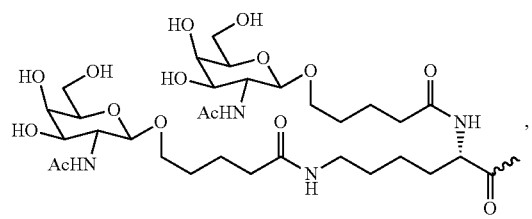
Formula XV
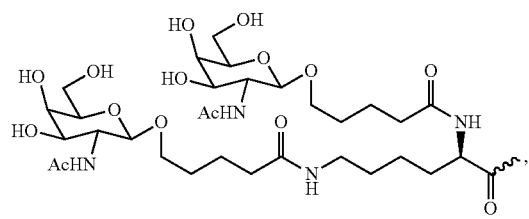
Formula XVI
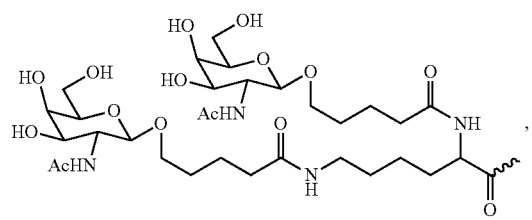
Formula XVII
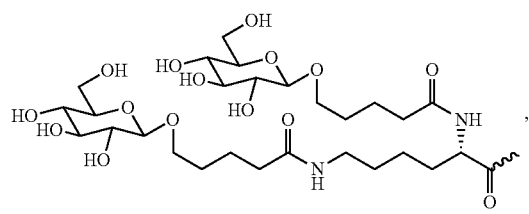

Formula XVIII
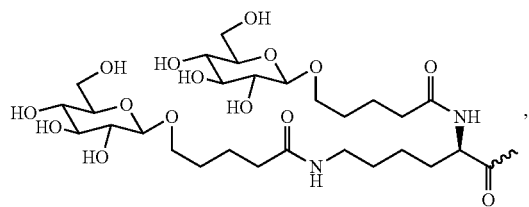
Formula XIX
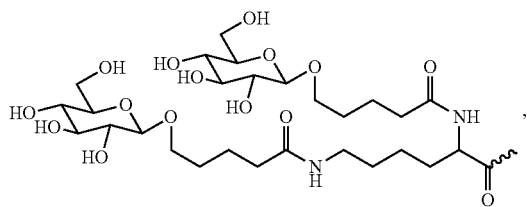
Formula XX
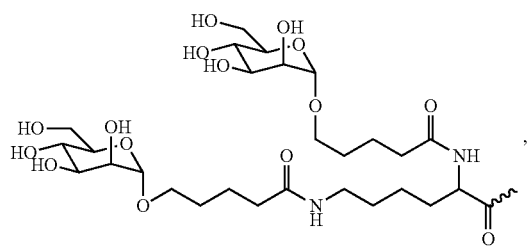
Formula XXI
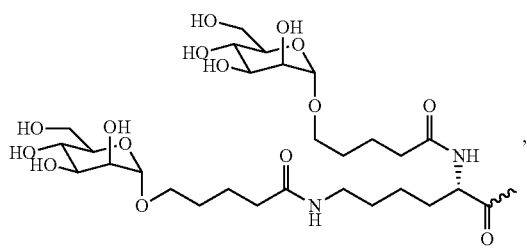
Formula XXII
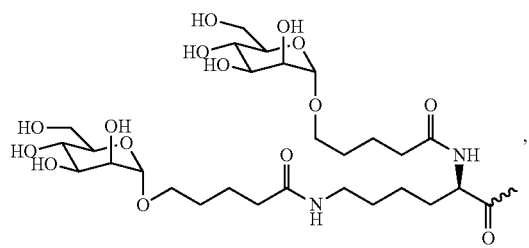
Formula XXIII
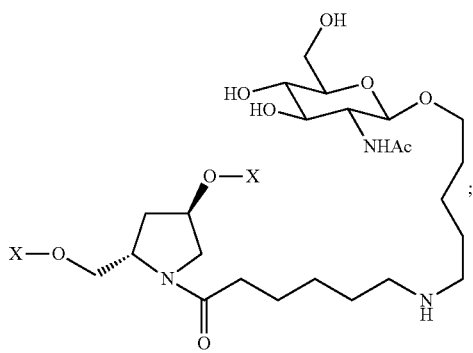
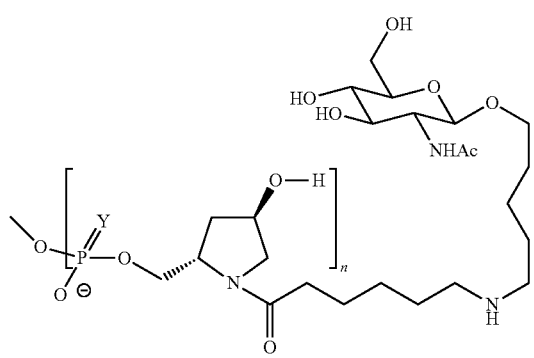

wherein Y is O or S and n is 3-6 (Formula XXIV);
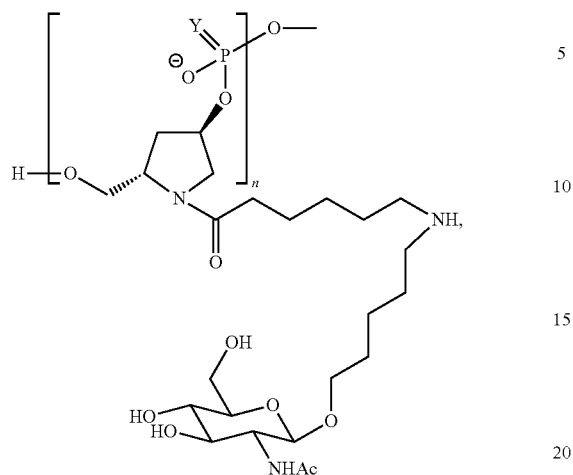
wherein Y is O or S and n is 3-6 (Formula XXV);
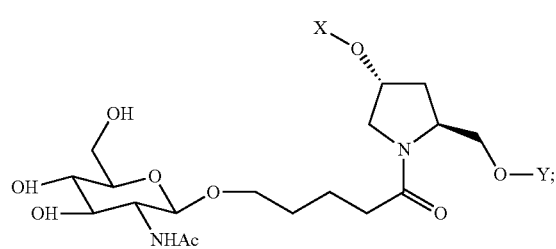
Formula XXVI
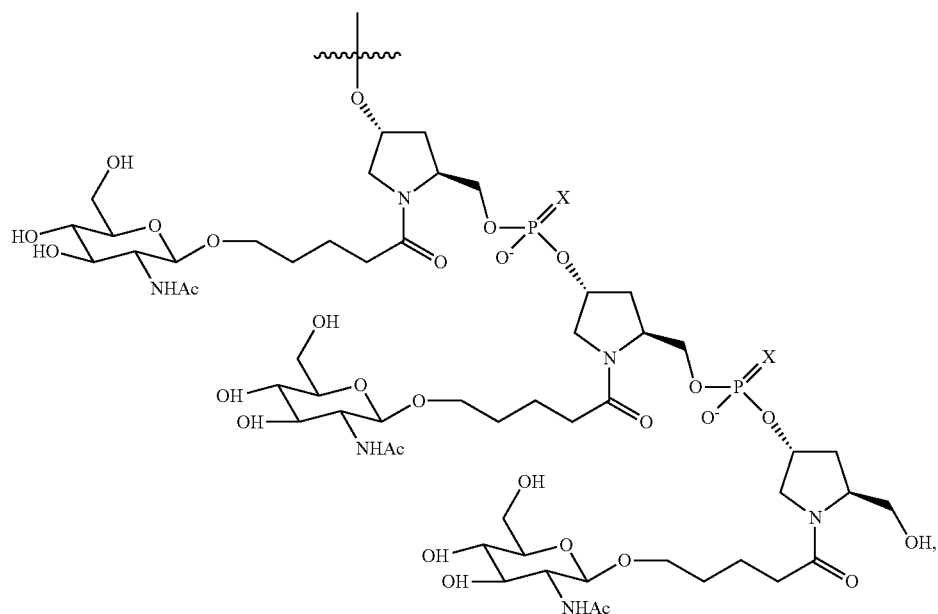
wherein X is O or S (Formula XXVII);

Formula XXVII
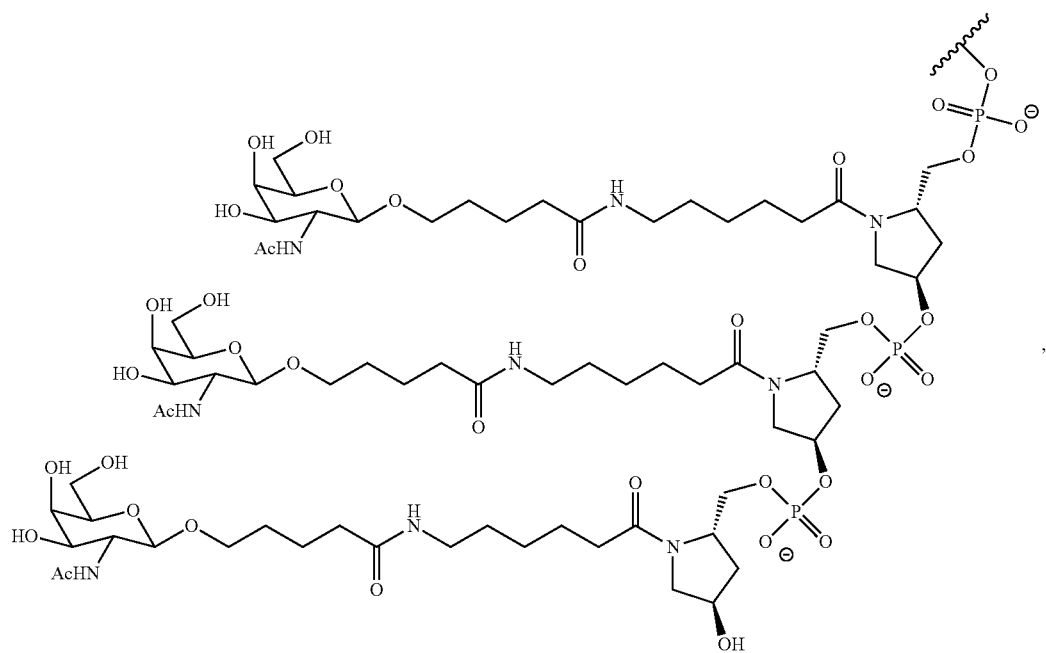
Formula XXIX
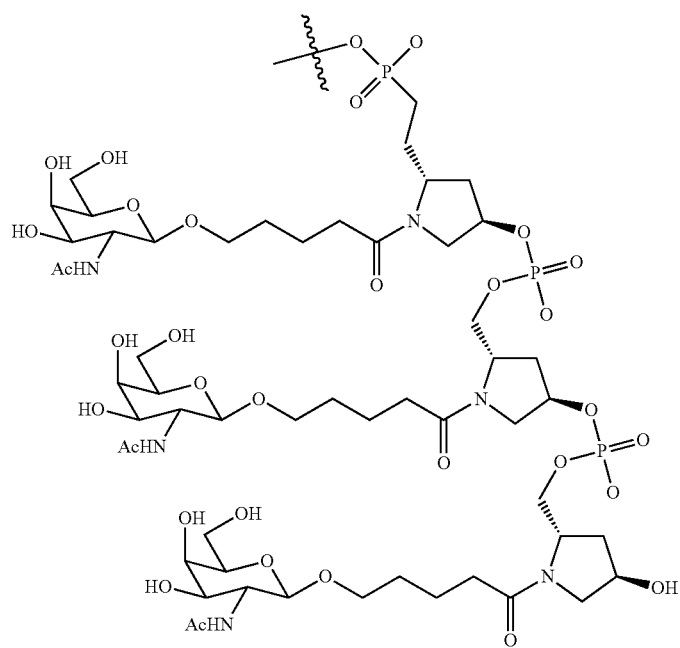

Formula XXX
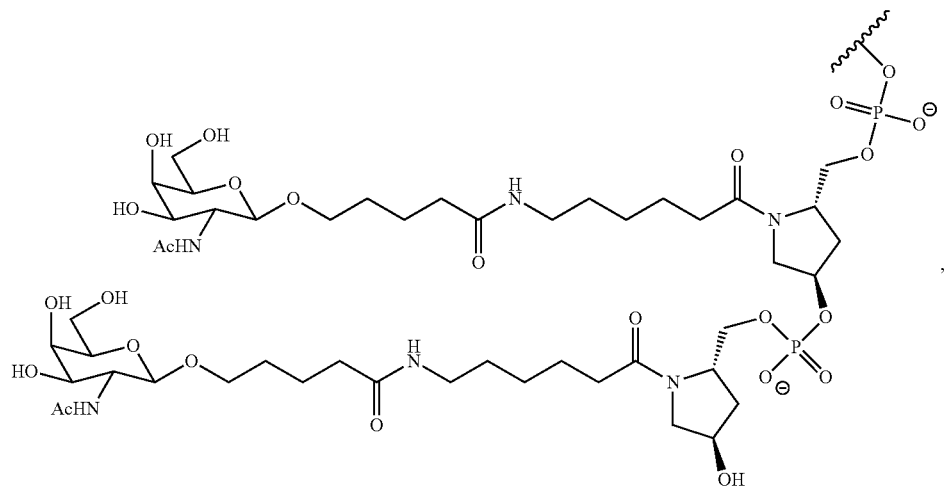
Formula XXXI
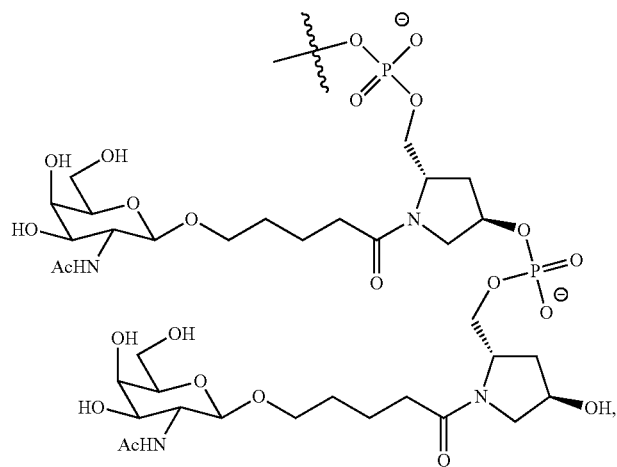
Formula XXXII
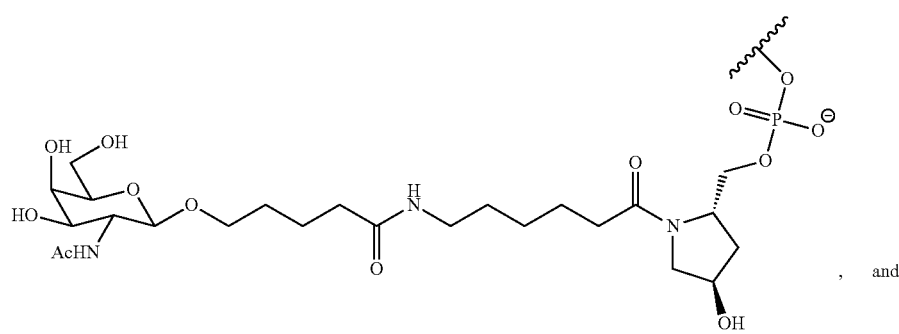
, and
Formula XXXIII
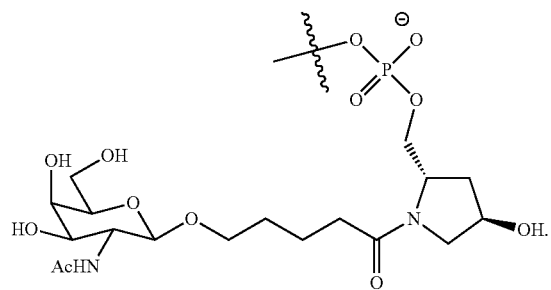

-continued

Formula XXIV

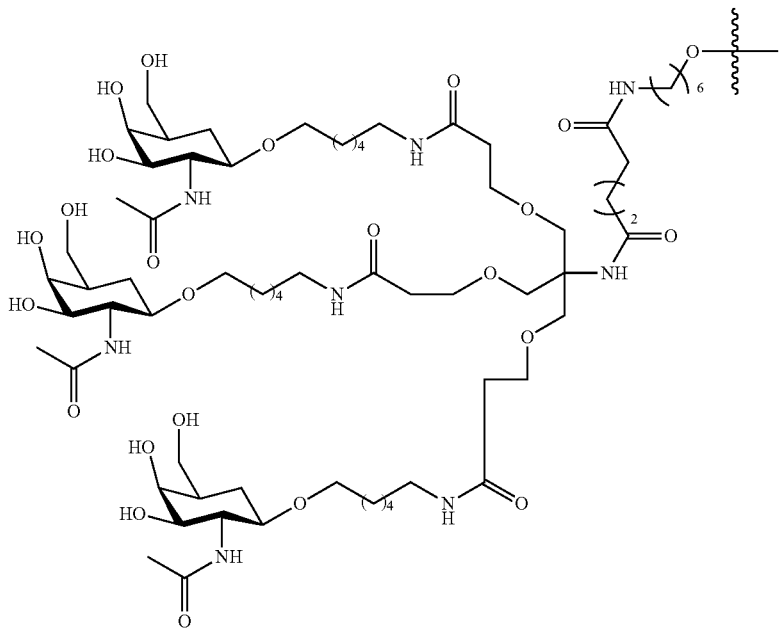

In another embodiment, a carbohydrate conjugate for use in the compositions and methods of the invention is a monosaccharide. In one embodiment, the monosaccharide is an N-acetylgalactosamine, such as Formula II

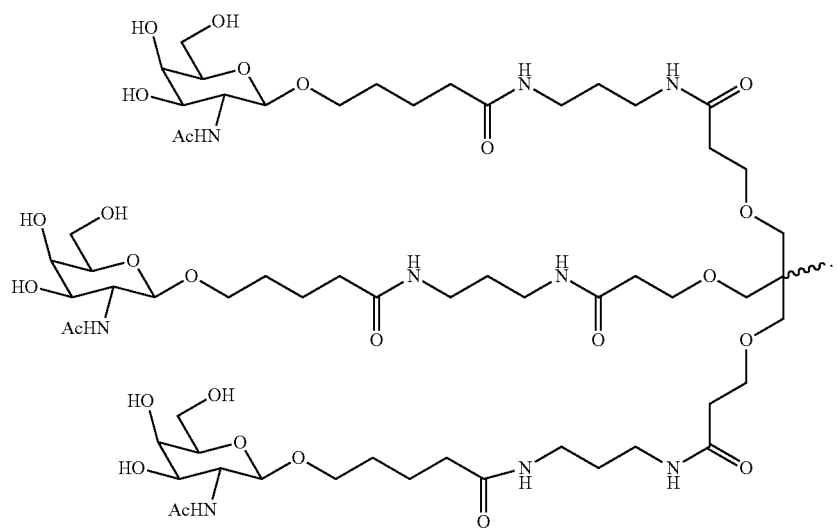

Another representative carbohydrate conjugate for use in the embodiments described herein includes, but is not limited to, (Formula XXXVI)
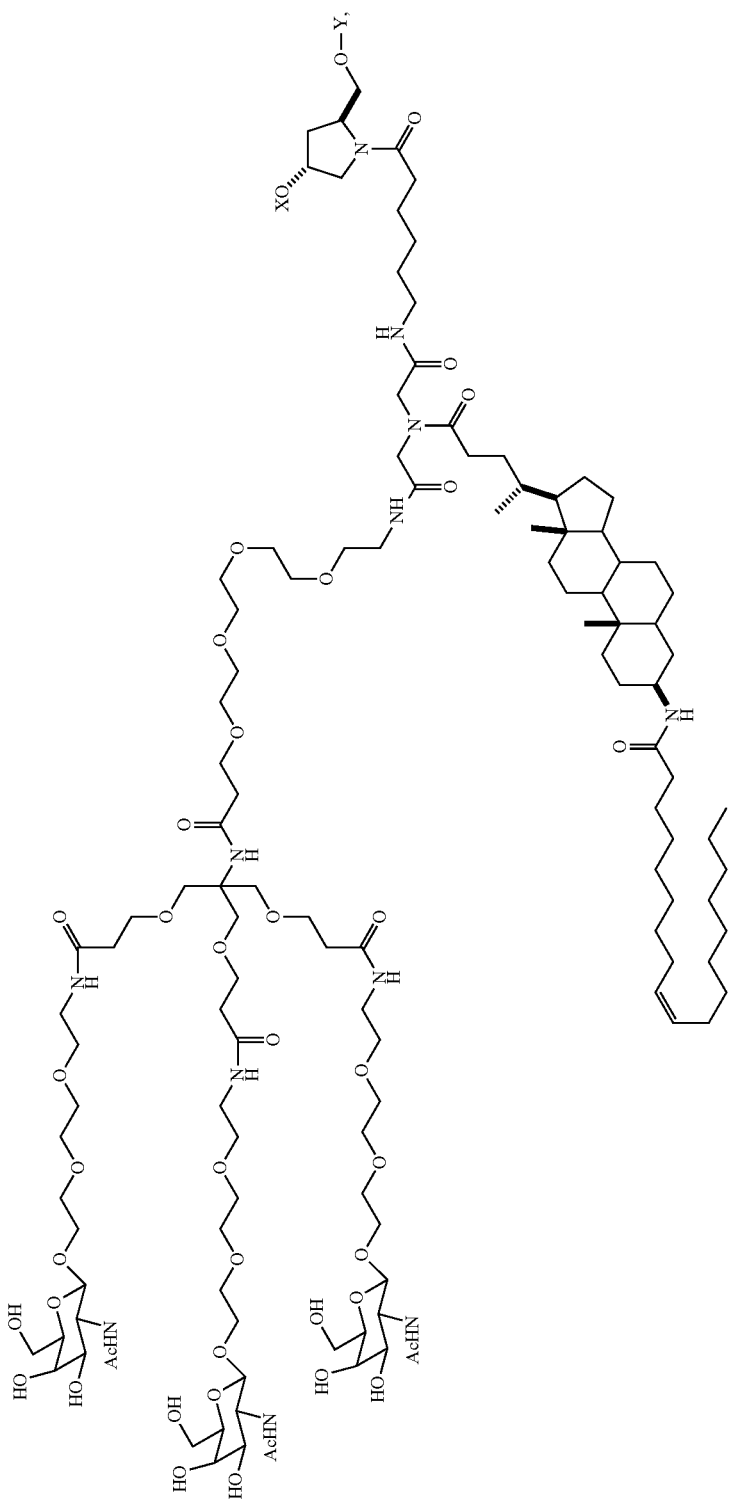

when one of X or Y is an oligonucleotide, the other is a hydrogen.

In certain embodiments of the invention, the GalNAc or GalNAc derivative is attached to an iRNA agent of the invention via a monovalent linker. In some embodiments, the GalNAc or GalNAc derivative is attached to an iRNA agent of the invention via a bivalent linker. In yet other embodiments of the invention, the GalNAc or GalNAc derivative is attached to an iRNA agent of the invention via a trivalent linker.

In one embodiment, the double stranded RNAi agents of the invention comprise one or more GalNAc or GalNAc derivative attached to the iRNA agent. The GalNAc may be attached to any nucleotide via a linker on the sense strand or antisense strand. The GalNac may be attached to the 5'-end of the sense strand, the 3' end of the sense strand, the 5'-end of the antisense strand, or the 3'-end of the antisense strand. In one embodiment, the GalNAc is attached to the 3' end of the sense strand, e.g., via a trivalent linker.

In other embodiments, the double stranded RNAi agents of the invention comprise a plurality (e.g., 2, 3, 4, 5, or 6) GalNAc or GalNAc derivatives, each independently attached to a plurality of nucleotides of the double stranded RNAi agent through a plurality of linkers, e.g., monovalent linkers.

In some embodiments, for example, when the two strands of an iRNA agent of the invention is part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker.

In some embodiments, the carbohydrate conjugate further comprises one or more additional ligands as described above, such as, but not limited to, a PK modulator or a cell permeation peptide.

Additional carbohydrate conjugates and linkers suitable for use in the present invention include those described in PCT Publication Nos. WO 2014/179620 and WO 2014/179627, the entire contents of each of which are incorporated herein by reference.

D. Linkers

In some embodiments, the conjugate or ligand described herein can be attached to an iRNA oligonucleotide with various linkers that can be cleavable or non-cleavable.

The term "linker" or "linking group" means an organic moiety that connects two parts of a compound, e.g., covalently attaches two parts of a compound. Linkers typically comprise a direct bond or an atom such as oxygen or sulfur, a unit such as NR8, C(O), C(O)NH, SO, $SO_2$, $SO_2$NH or a chain of atoms, such as, but not limited to, substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkenyl, alkynylheterocyclylalkynyl, alkylaryl, alkenylaryl, alkynylaryl, alkylheteroaryl, alkenylheteroaryl, alkynylhereroaryl, which one or more methylenes can be interrupted or terminated by O, S, S(O), $SO_2$, N(R8), C(O), substituted or unsubstituted aryl, substituted or unsubstituted heteroaryl, or substituted or unsubstituted heterocyclic; where R8 is hydrogen, acyl, aliphatic, or substituted aliphatic. In one embodiment, the linker is about 1-24 atoms, 2-24, 3-24, 4-24, 5-24, 6-24, 6-18, 7-18, 8-18, 7-17, 8-17, 6-16, 7-17, or 8-16 atoms.

A cleavable linking group is one which is sufficiently stable outside the cell, but which upon entry into a target cell is cleaved to release the two parts the linker is holding together. In a preferred embodiment, the cleavable linking group is cleaved at least about 10 times, 20, times, 30 times, 40 times, 50 times, 60 times, 70 times, 80 times, 90 times, or more, or at least 100 times faster in a target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential, or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a preferred pH, thereby releasing a cationic lipid from the ligand inside the cell, or into the desired compartment of the cell.

A linker can include a cleavable linking group that is cleavable by a particular enzyme. The type of cleavable linking group incorporated into a linker can depend on the cell to be targeted. For example, a liver-targeting ligand can be linked to a cationic lipid through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis.

Linkers that contain peptide bonds can be used when targeting cell types rich in peptidases, such as liver cells and synoviocytes.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It can be useful to make initial evaluations in cell-free or culture conditions and to confirm by further evaluations in whole animals. In preferred embodiments, useful candidate compounds are cleaved at least about 2, 4, 10, 20, 30, 40, 50, 60, 70, 80, 90, or 100 times faster in the cell (or under in vitro conditions selected to mimic intracellular conditions) as compared to blood or serum (or under in vitro conditions selected to mimic extracellular conditions).

i. Redox Cleavable Linking Groups

In certain embodiments, a cleavable linking group is a redox cleavable linking group that is cleaved upon reduction or oxidation. An example of reductively cleavable linking group is a disulphide linking group (—S—S—). To determine if a candidate cleavable linking group is a suitable "reductively cleavable linking group," or for example is suitable for use with a particular iRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In one, candidate compounds are cleaved by at most about 10% in the blood. In other embodiments, useful candidate compounds are degraded at least about 2, 4, 10, 20, 30, 40, 50, 60, 70, 80, 90, or about 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

ii. Phosphate-Based Cleavable Linking Groups

In other embodiments, a cleavable linker comprises a phosphate-based cleavable linking group. A phosphate-based cleavable linking group is cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—. Preferred embodiments are —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O, —S—P(S)(H)—O—, —S—P(O)(H)—S—, and —O—P(S)(H)—S—. A preferred embodiment is —O—P(O)(OH)—O—. These candidates can be evaluated using methods analogous to those described above.

iii. Acid Cleavable Linking Groups

In other embodiments, a cleavable linker comprises an acid cleavable linking group. An acid cleavable linking group is a linking group that is cleaved under acidic conditions. In preferred embodiments acid cleavable linking groups are cleaved in an acidic environment with a pH of about 6.5 or lower (e.g., about 6.0, 5.5, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN—, C(O)O, or —OC(O). A preferred embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

iv. Ester-Based Linking Groups

In other embodiments, a cleavable linker comprises an ester-based cleavable linking group. An ester-based cleavable linking group is cleaved by enzymes such as esterases and amidases in cells. Examples of ester-based cleavable linking groups include, but are not limited to, esters of alkylene, alkenylene and alkynylene groups. Ester cleavable linking groups have the general formula —C(O)O—, or —OC(O)—. These candidates can be evaluated using methods analogous to those described above.

v. Peptide-Based Cleaving Groups

In yet other embodiments, a cleavable linker comprises a peptide-based cleavable linking group. A peptide-based cleavable linking group is cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynelene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHRAC(O)NHCHRBC(O)—, where RA and RB are the R groups of the two adjacent amino acids. These candidates can be evaluated using methods analogous to those described above.

In some embodiments, an iRNA of the invention is conjugated to a carbohydrate through a linker. Non-limiting examples of iRNA carbohydrate conjugates with linkers of the compositions and methods of the invention include, but are not limited to, (Formula XXXVII)
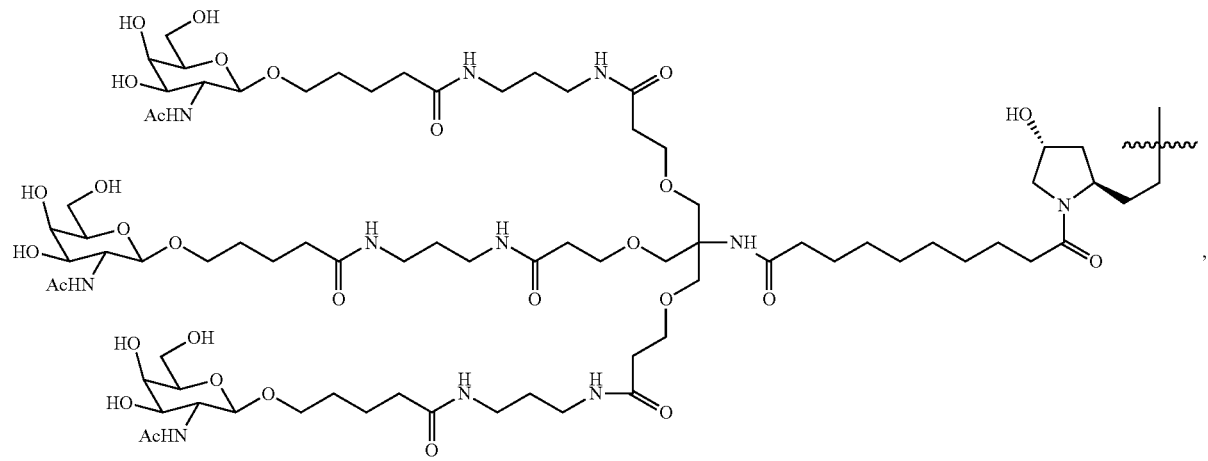
(Formula XXXVIII)
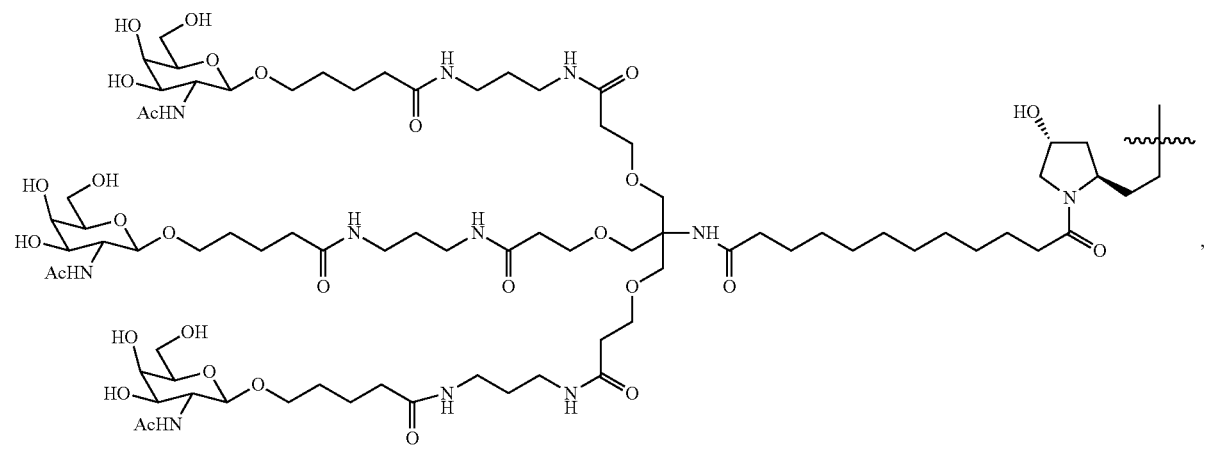
(Formula XXXIX)
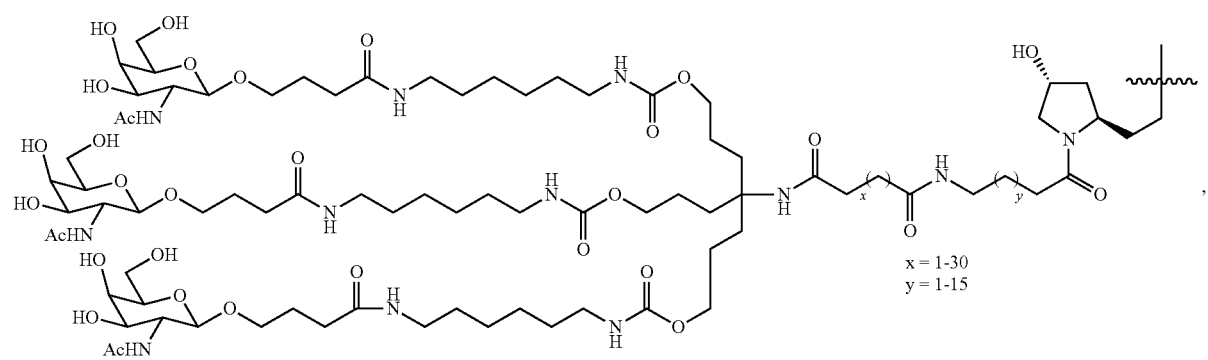
x = 1-30
y = 1-15
(Formula XL)
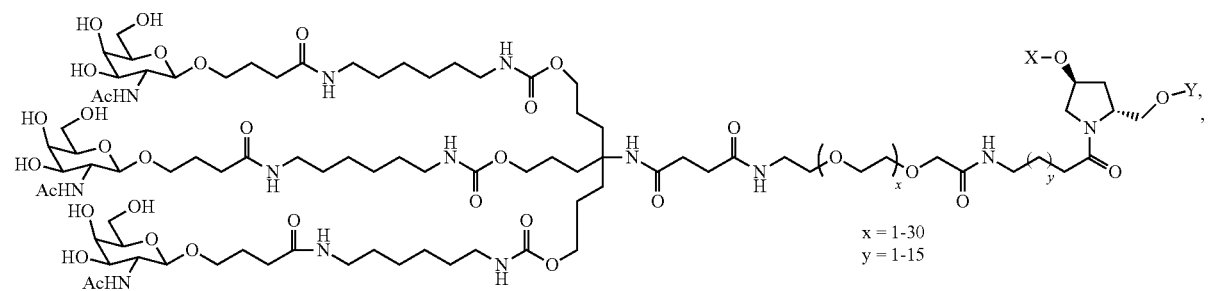
x = 1-30
y = 1-15

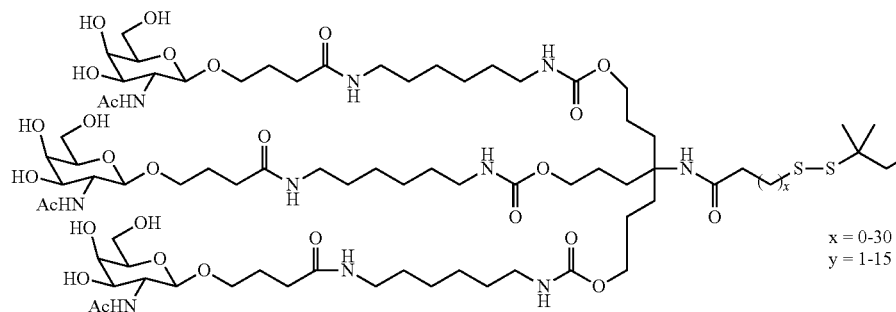

(Formula XLI)

x = 0-30
y = 1-15

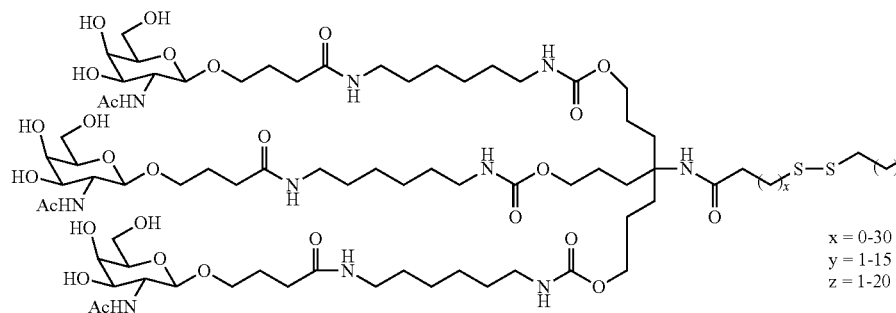

(Formula XLII)

x = 0-30
y = 1-15
z = 1-20

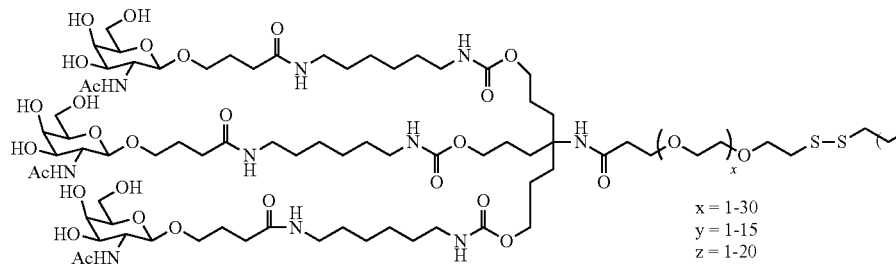

(Formula XLIII)

x = 1-30
y = 1-15
z = 1-20 and

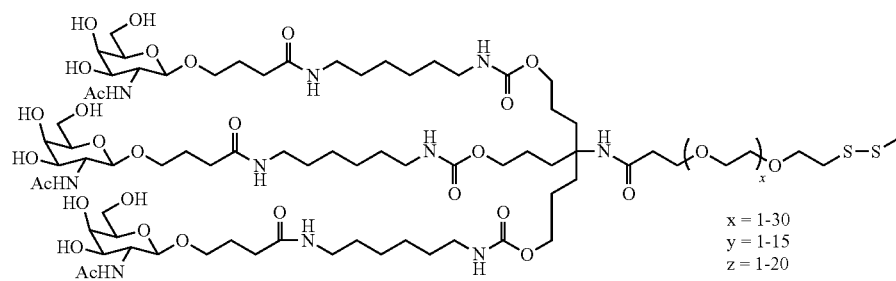

(Formula XLIV)

x = 1-30
y = 1-15
z = 1-20 when one of X or Y is an oligonucleotide, the other is a hydrogen.

In certain embodiments of the compositions and methods of the invention, a ligand is one or more "GalNAc" (N-acetylgalactosamine) derivatives attached through a bivalent or trivalent branched linker.

In one embodiment, a dsRNA of the invention is conjugated to a bivalent or trivalent branched linker selected from the group of structures shown in any of formula (XLV)-(XLVI):

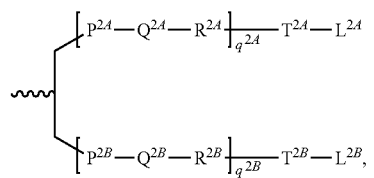

Formula XXXXV

Formula XLVI

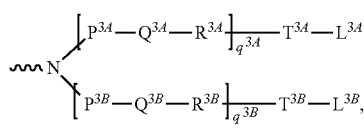

Formula XLVII

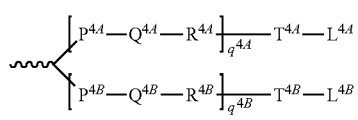

Formula XLVIII

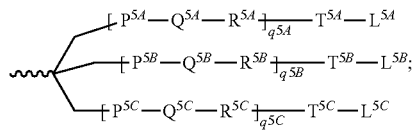

wherein:

q2A, q2B, q3A, q3B, q4A, q4B, q5A, q5B and q5C represent independently for each occurrence 0-20 and wherein the repeating unit can be the same or different;

$P^{2A}$, $P^{2B}$, $P^{3A}$, $P^{3B}$, $P^{4A}$, $P^{4B}$, $P^{5A}$, $P^{5B}$, $P^{5C}$, $T^{2A}$, $T^{2B}$, $T^{3A}$, $T^{3B}$, $T^{4A}$, $T^{4B}$, $T^{4A}$, $T^{5B}$, $T^{5C}$ are each independently for each occurrence absent, CO, NH, O, S, OC(O), NHC(O), CH$_2$, CH$_2$NH or CH$_2$O;

$Q^{2A}$, $Q^{2B}$, $Q^{3A}$, $Q^{3B}$, $Q^{4A}$, $Q^{4B}$, $Q^{5A}$, $Q^{5B}$, $Q^{5C}$ are independently for each occurrence absent, alkylene, substituted alkylene wherein one or more methylenes can be interrupted or terminated by one or more of O, S, S(O), SO$_2$, N(R$^N$), C(R')=C(R''), C≡C or C(O);

$R^{2A}$, $R^{2B}$, $R^{3A}$, $R^{3B}$, $R^{4A}$, $R^{4B}$, $R^{5A}$, $R^{5B}$, $R^{5C}$ are each independently for each occurrence absent, NH, O, S, CH$_2$, C(O)O, C(O)NH, NHCH(R$^a$)C(O), —C(O)—CH(R$^a$)—NH—, CO, CH=N—O,

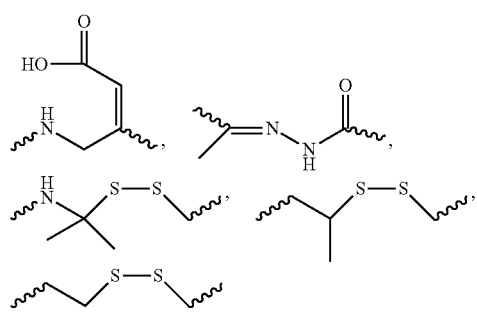

or heterocylyl;

$L^{2A}$, $L^{2B}$, $L^{3A}$, $L^{3B}$, $L^{4A}$, $L^{4B}$, $L^{5A}$, $L^{5B}$ and $L^{5C}$ represent the ligand; i.e. each independently for each occurrence a monosaccharide (such as GalNAc), disaccharide, trisaccharide, tetrasaccharide, oligosaccharide, or polysaccharide; and R$^a$ is H or amino acid side chain. Trivalent conjugating GalNAc derivatives are particularly useful for use with RNAi agents for inhibiting the expression of a target gene, such as those of formula (XLIX):

Formula XLIX

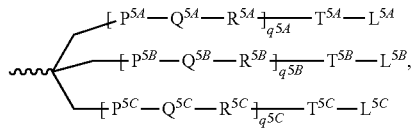

wherein $L^{5A}$, $L^{5B}$ and $L^{5C}$ represent a monosaccharide, such as GalNAc derivative.

Examples of suitable bivalent and trivalent branched linker groups conjugating GalNAc derivatives include, but are not limited to, the structures recited above as formulas II, VII, XI, X, and XIII.

Representative U.S. patents that teach the preparation of RNA conjugates include, but are not limited to, U.S. Pat. Nos. 4,828,979; 4,948,882; 5,218,105; 5,525,465; 5,541,313; 5,545,730; 5,552,538; 5,578,717; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928; 5,688,941; 6,294,664; 6,320,017; 6,576,752; 6,783,931; 6,900,297; 7,037,646; and 8,106,022, the entire contents of each of which are hereby incorporated herein by reference.

It is not necessary for all positions in a given compound to be uniformly modified, and in fact more than one of the aforementioned modifications can be incorporated in a single compound or even at a single nucleoside within an iRNA. The present invention also includes iRNA compounds that are chimeric compounds.

"Chimeric" iRNA compounds or "chimeras," in the context of this invention, are iRNA compounds, preferably dsRNAi agents, that contain two or more chemically distinct regions, each made up of at least one monomer unit, i.e., a nucleotide in the case of a dsRNA compound. These iRNAs typically contain at least one region wherein the RNA is modified so as to confer upon the iRNA increased resistance to nuclease degradation, increased cellular uptake, or increased binding affinity for the target nucleic acid. An additional region of the iRNA can serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of iRNA inhibition of gene expression. Consequently, comparable results can often be obtained with shorter iRNAs when chimeric dsRNAs are used, compared to phosphorothioate deoxy dsRNAs hybridizing to the same target region. Cleavage of the RNA target can be routinely detected by gel electrophoresis and, if necessary, associated nucleic acid hybridization techniques known in the art.

In certain instances, the RNA of an iRNA can be modified by a non-ligand group. A number of non-ligand molecules have been conjugated to iRNAs in order to enhance the activity, cellular distribution or cellular uptake of the iRNA, and procedures for performing such conjugations are available in the scientific literature. Such non-ligand moieties have included lipid moieties, such as cholesterol (Kubo, T.

et al., *Biochem. Biophys. Res. Comm.,* 2007, 365(1):54-61; Letsinger et al., *Proc. Natl. Acad. Sci. USA,* 1989, 86:6553), cholic acid (Manoharan et al., *Bioorg. Med. Chem. Lett.,* 1994, 4:1053), athioether, e.g., hexyl-S-tritylthiol (Manoharan et al., *Ann. N. Y. Acad. Sci.,* 1992, 660:306; Manoharan et al., *Bioorg. Med. Chem. Let.,* 1993, 3:2765), a thiocholesterol (Oberhauser et al., *Nucl. Acids Res.,* 1992, 20:533), an aliphatic chain, e.g., dodecandiol or undecyl residues (Saison-Behmoaras et al., *EMBO J.,* 1991, 10:111; Kabanov et al., *FEBS Lett.,* 1990, 259:327; Svinarchuk et al., *Biochimie,* 1993, 75:49), a phospholipid, e.g., di-hexadecyl-rac-glycerol or triethylammonium 1,2-di-O-hexadecyl-rac-glycero-3-H-phosphonate (Manoharan et al., *Tetrahedron Lett.,* 1995, 36:3651; Shea et al., *Nucl. Acids Res.,* 1990, 18:3777), a polyamine or a polyethylene glycol chain (Manoharan et al., *Nucleosides & Nucleotides,* 1995, 14:969), or adamantane acetic acid (Manoharan et al., *Tetrahedron Lett.,* 1995, 36:3651), a palmityl moiety (Mishra et al., *Biochim. Biophys. Acta,* 1995, 1264:229), or an octadecylamine or hexylamino-carbonyl-oxycholesterol moiety (Crooke et al., *J. Pharmacol. Exp. Ther.,* 1996, 277:923). Representative United States patents that teach the preparation of such RNA conjugates have been listed above. Typical conjugation protocols involve the synthesis of RNAs bearing an aminolinker at one or more positions of the sequence. The amino group is then reacted with the molecule being conjugated using appropriate coupling or activating reagents. The conjugation reaction can be performed either with the RNA still bound to the solid support or following cleavage of the RNA, in solution phase. Purification of the RNA conjugate by HPLC typically affords the pure conjugate.

IV. Delivery of an iRNA of the Invention

The delivery of an iRNA of the invention to a cell e.g., a cell within a subject, such as a human subject (e.g., a subject in need thereof, such as a subject susceptible to or diagnosed with a solute carrier family member-associated disorder, e.g., a hypermanganesemia, such as manganism) can be achieved in a number of different ways. For example, delivery may be performed by contacting a cell with an iRNA of the invention either in vitro or in vivo. In vivo delivery may also be performed directly by administering a composition comprising an iRNA, e.g., a dsRNA, to a subject. Alternatively, in vivo delivery may be performed indirectly by administering one or more vectors that encode and direct the expression of the iRNA. These alternatives are discussed further below.

In general, any method of delivering a nucleic acid molecule (in vitro or in vivo) can be adapted for use with an iRNA of the invention (see e.g., Akhtar S. and Julian R L. (1992) *Trends Cell. Biol.* 2(5):139-144 and WO94/02595, which are incorporated herein by reference in their entireties). For in vivo delivery, factors to consider in order to deliver an iRNA molecule include, for example, biological stability of the delivered molecule, prevention of nonspecific effects, and accumulation of the delivered molecule in the target tissue. RNA interference has also shown success with local delivery to the CNS by direct injection (Dorn, G., et al. (2004) *Nucleic Acids* 32:e49; Tan, P H., et al (2005) *Gene Ther.* 12:59-66; Makimura, H., et al (2002) *BMC Neurosci.* 3:18; Shishkina, G T., et al (2004) *Neuroscience* 129:521-528; Thakker, E R., et al (2004) *Proc. Natl. Acad. Sci. U.S.A.* 101:17270-17275; Akaneya, Y., et al (2005) *J Neurophysiol.* 93:594-602). Modification of the RNA or the pharmaceutical carrier can also permit targeting of the iRNA to the target tissue and avoid undesirable off-target effects. iRNA molecules can be modified by chemical conjugation to lipophilic groups such as cholesterol to enhance cellular uptake and prevent degradation. For example, an iRNA directed against ApoB conjugated to a lipophilic cholesterol moiety was injected systemically into mice and resulted in knockdown of apoB mRNA in both the liver and jejunum (Soutschek, J., et al (2004) *Nature* 432:173-178).

In an alternative embodiment, the iRNA can be delivered using drug delivery systems such as a nanoparticle, a dendrimer, a polymer, liposomes, or a cationic delivery system. Positively charged cationic delivery systems facilitate binding of an iRNA molecule (negatively charged) and also enhance interactions at the negatively charged cell membrane to permit efficient uptake of an iRNA by the cell. Cationic lipids, dendrimers, or polymers can either be bound to an iRNA, or induced to form a vesicle or micelle (see e.g., Kim S H, et al (2008) *Journal of Controlled Release* 129(2):107-116) that encases an iRNA. The formation of vesicles or micelles further prevents degradation of the iRNA when administered systemically. Methods for making and administering cationic-iRNA complexes are well within the abilities of one skilled in the art (see e.g., Sorensen, D R, et al (2003) *J. Mol. Biol* 327:761-766; Verma, U N, et al (2003) *Clin. Cancer Res.* 9:1291-1300; Arnold, A S et al (2007) *J Hypertens.* 25:197-205, which are incorporated herein by reference in their entirety). Some non-limiting examples of drug delivery systems useful for systemic delivery of iRNAs include DOTAP (Sorensen, D R., et al (2003), supra; Verma, U N, et al (2003), supra), "solid nucleic acid lipid particles" (Zimmermann, T S, et al (2006) *Nature* 441:111-114), cardiolipin (Chien, P Y, et al (2005) *Cancer Gene Ther.* 12:321-328; Pal, A, et al (2005) *Int J. Oncol.* 26:1087-1091), polyethyleneimine (Bonnet M E, et al (2008) *Pharm. Res.* August 16 Epub ahead of print; Aigner, A. (2006) *J. Biomed. Biotechnol.* 71659), Arg-Gly-Asp (RGD) peptides (Liu, S. (2006) *Mol. Pharm.* 3:472-487), and polyamidoamines (Tomalia, D A, et al (2007) *Biochem. Soc. Trans.* 35:61-67; Yoo, H., et al (1999) *Pharm. Res.* 16:1799-1804). In some embodiments, an iRNA forms a complex with cyclodextrin for systemic administration. Methods for administration and pharmaceutical compositions of iRNAs and cyclodextrins can be found in U.S. Pat. No. 7,427,605, which is herein incorporated by reference in its entirety.

A. Vector Encoded iRNAs of the Invention iRNA targeting a solute carrier family member gene, e.g., an SLC30A10 gene or an SLC39A8 gene, can be expressed from transcription units inserted into DNA or RNA vectors (see, e.g., Couture, A, et al., *TIG.* (1996), 12:5-10; Skillern, A, et al., International PCT Publication No. WO 00/22113, Conrad, International PCT Publication No. WO 00/22114, and Conrad, U.S. Pat. No. 6,054,299). Expression can be transient (on the order of hours to weeks) or sustained (weeks to months or longer), depending upon the specific construct used and the target tissue or cell type. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., *Proc. Natl. Acad. Sci. USA* (1995) 92:1292).

Viral vector systems which can be utilized with the methods and compositions described herein include, but are not limited to, (a) adenovirus vectors; (b) retrovirus vectors, including but not limited to lentiviral vectors, moloney murine leukemia virus, etc.; (c) adeno-associated virus vectors; (d) herpes simplex virus vectors; (e) SV 40 vectors; (f) polyoma virus vectors; (g) papilloma virus vectors; (h) picornavirus vectors; (i) pox virus vectors such as an orthopox, e.g., vaccinia virus vectors or avipox, e.g. canary pox or fowl pox; and (j) a helper-dependent or gutless adenovirus. Replication-defective viruses can also be advantageous. Different vectors will or will not become incorporated into the cells' genome. The constructs can include viral sequences for transfection, if desired. Alternatively, the construct can be incorporated into vectors capable of episomal replication, e.g. EPV and EBV vectors. Constructs for the recombinant expression of an iRNA will generally require regulatory elements, e.g., promoters, enhancers, etc., to ensure the expression of the iRNA in target cells. Other aspects to consider for vectors and constructs are known in the art.

V. Pharmaceutical Compositions of the Invention

The present invention also includes pharmaceutical compositions and formulations which include the iRNAs of the invention. In one embodiment, provided herein are pharmaceutical compositions containing an iRNA, as described herein, and a pharmaceutically acceptable carrier. The pharmaceutical compositions containing the iRNA are useful for preventing or treating a solute carrier family member-associated disorder, e.g., a hypermanganesemia, such as manganism. Such pharmaceutical compositions are formulated based on the mode of delivery. One example is compositions that are formulated for systemic administration via parenteral delivery, e.g., by subcutaneous (SC), intramuscular (IM), or intravenous (IV) delivery. The pharmaceutical compositions of the invention may be administered in dosages sufficient to inhibit expression of a solute carrier family member gene, e.g., an SLC30A10 gene or an SLC39A8 gene.

In some embodiments, the pharmaceutical compositions of the invention are sterile. In another embodiment, the pharmaceutical compositions of the invention are pyrogen free.

The pharmaceutical compositions of the invention may be administered in dosages sufficient to inhibit expression of a solute carrier family member gene, e.g., an SLC30A10 gene or an SLC39A8 gene. In general, a suitable dose of an iRNA of the invention will be in the range of about 0.001 to about 200.0 milligrams per kilogram body weight of the recipient per day, generally in the range of about 1 to 50 mg per kilogram body weight per day. Typically, a suitable dose of an iRNA of the invention will be in the range of about 0.1 mg/kg to about 5.0 mg/kg, preferably about 0.3 mg/kg and about 3.0 mg/kg. A repeat-dose regimen may include administration of a therapeutic amount of iRNA on a regular basis, such as every month, once every 3-6 months, or once a year. In certain embodiments, the iRNA is administered about once per month to about once per six months.

After an initial treatment regimen, the treatments can be administered on a less frequent basis. Duration of treatment can be determined based on the severity of disease.

In other embodiments, a single dose of the pharmaceutical compositions can be long lasting, such that doses are administered at not more than 1, 2, 3, or 4 month intervals. In some embodiments of the invention, a single dose of the pharmaceutical compositions of the invention is administered about once per month. In other embodiments of the invention, a single dose of the pharmaceutical compositions of the invention is administered quarterly (i.e., about every three months). In other embodiments of the invention, a single dose of the pharmaceutical compositions of the invention is administered twice per year (i.e., about once every six months).

The skilled artisan will appreciate that certain factors can influence the dosage and timing required to effectively treat a subject, including but not limited to mutations present in the subject, previous treatments, the general health or age of the subject, and other diseases present. Moreover, treatment of a subject with a prophylactically or therapeutically effective amount, as appropriate, of a composition can include a single treatment or a series of treatments.

The iRNA can be delivered in a manner to target a particular tissue (e.g., hepatocytes).

Pharmaceutical compositions of the present invention include, but are not limited to, solutions, emulsions, and liposome-containing formulations. These compositions can be generated from a variety of components that include, but are not limited to, preformed liquids, self-emulsifying solids, and self-emulsifying semisolids. Formulations include those that target the liver.

The pharmaceutical formulations of the present invention, which can conveniently be presented in unit dosage form, can be prepared according to conventional techniques well known in the pharmaceutical industry. Such techniques include the step of bringing into association the active ingredients with the pharmaceutical carrier(s) or excipient (s). In general, the formulations are prepared by uniformly and intimately bringing into association the active ingredients with liquid carriers.

A. Additional Formulations i. Emulsions

The compositions of the present invention can be prepared and formulated as emulsions. Emulsions are typically heterogeneous systems of one liquid dispersed in another in the form of droplets usually exceeding 0.1 µm in diameter (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions can be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions can contain additional components in addition to the dispersed phases, and the active drug which can be present as a solution either in the aqueous phase, oily phase or itself as a separate phase. Pharmaceutical excipients such as emulsifiers, stabilizers, dyes, and anti-oxidants can also be present in emulsions as needed. Pharmaceutical emulsions can also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Other means of stabilizing emulsions entail the use of emulsifiers that can be incorporated into either phase of the emulsion. Emulsifiers can broadly be classified into four categories: synthetic surfactants, naturally occurring emulsifiers, absorption bases, and finely dispersed solids (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants can be classified into different classes based on the nature of the hydrophilic group: nonionic, anionic, cationic, and amphoteric (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY Rieger, in Pharmaceutical Dosage Forms, Lieberman, Rieger and Banker (Eds.), 1988, Marcel Dekker, Inc., New York, N.Y., volume 1, p. 285).

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives, and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

The application of emulsion formulations via dermatological, oral, and parenteral routes, and methods for their manufacture have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Idson, in Pharmaceutical Dosage Forms, Lieberman, Rieger and Banker (Eds.), 1988, Marcel Dekker, Inc., New York, N.Y., volume 1, p. 199).

ii. Microemulsions

In one embodiment of the present invention, the compositions of iRNAs and nucleic acids are formulated as microemulsions. A microemulsion can be defined as a system of water, oil, and amphiphile which is a single optically isotropic and thermodynamically stable liquid solution (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Rosoff, in Pharmaceutical Dosage Forms, Lieberman, Rieger and Banker (Eds.), 1988, Marcel Dekker, Inc., New York, N.Y., volume 1, p. 245). Typically microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215).

iii. Microparticles

An iRNA of the invention may be incorporated into a particle, e.g., a microparticle. Microparticles can be produced by spray-drying, but may also be produced by other methods including lyophilization, evaporation, fluid bed drying, vacuum drying, or a combination of these techniques.

iv. Penetration Enhancers

In one embodiment, the present invention employs various penetration enhancers to effect the efficient delivery of nucleic acids, particularly iRNAs, to the skin of animals. Most drugs are present in solution in both ionized and nonionized forms. However, usually only lipid soluble or lipophilic drugs readily cross cell membranes. It has been discovered that even non-lipophilic drugs can cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers can be classified as belonging to one of five broad categories, i.e., surfactants, fatty acids, bile salts, chelating agents, and non-chelating non-surfactants (see e.g., Malmsten, M. Surfactants and polymers in drug delivery, Informa Health Care, New York, NY, 2002; Lee et al., Critical Reviews in Therapeutic Drug Carrier Systems, 1991, p. 92). Each of the above mentioned classes of penetration enhancers and their use in manufacture of pharmaceutical compositions and delivery of pharmaceutical agents are well known in the art.

v. Excipients

In contrast to a carrier compound, a "pharmaceutical carrier" or "excipient" is a pharmaceutically acceptable solvent, suspending agent, or any other pharmacologically inert vehicle for delivering one or more nucleic acids to an animal. The excipient can be liquid or solid and is selected, with the planned manner of administration in mind, so as to provide for the desired bulk, consistency, etc., when combined with a nucleic acid and the other components of a given pharmaceutical composition. Such agent are well known in the art.

vi. Other Components

The compositions of the present invention can additionally contain other adjunct components conventionally found in pharmaceutical compositions, at their art-established usage levels. Thus, for example, the compositions can contain additional, compatible, pharmaceutically-active materials such as, for example, antipruritics, astringents, local anesthetics or anti-inflammatory agents, or can contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings, or aromatic substances, and the like which do not deleteriously interact with the nucleic acid(s) of the formulation.

Aqueous suspensions can contain substances which increase the viscosity of the suspension including, for example, sodium carboxymethylcellulose, sorbitol, or dextran. The suspension can also contain stabilizers.

In some embodiments, pharmaceutical compositions featured in the invention include (a) one or more iRNA and (b) one or more agents which function by a non-iRNA mechanism and which are useful in treating a solute carrier family member-associated disorder, e.g., hypermanganesemia.

Toxicity and prophylactic efficacy of such compounds can be determined by standard pharmaceutical procedures in cell cultures or experimental animals, e.g., for determining the LD50 (the dose lethal to 50% of the population) and the ED50 (the dose prophylactically effective in 50% of the population). The dose ratio between toxic and therapeutic effects is the therapeutic index and it can be expressed as the ratio LD50/ED50. Compounds that exhibit high therapeutic indices are preferred.

The data obtained from cell culture assays and animal studies can be used in formulating a range of dosage for use in humans. The dosage of compositions featured herein in the invention lies generally within a range of circulating concentrations that include the ED50, preferably an ED80 or ED90, with little or no toxicity. The dosage can vary within this range depending upon the dosage form employed and the route of administration utilized. For any compound used in the methods featured in the invention, the prophylactically effective dose can be estimated initially from cell culture assays. A dose can be formulated in animal models to achieve a circulating plasma concentration range of the compound or, when appropriate, of the polypeptide product of a target sequence (e.g., achieving a decreased concentration of the polypeptide) that includes the IC50 (i.e., the concentration of the test compound which achieves a half-maximal inhibition of symptoms) or higher levels of inhibition as determined in cell culture. Such information can be used to more accurately determine useful doses in humans. Levels in plasma can be measured, for example, by high performance liquid chromatography.

In addition to their administration, as discussed above, the iRNAs featured in the invention can be administered in combination with other known agents used for the prevention or treatment of a solute carrier family member-associated disorder, e.g., hypermanganesemia. In any event, the administering physician can adjust the amount and timing of iRNA administration on the basis of results observed using standard measures of efficacy known in the art or described herein.

VI. Methods for Inhibiting Expression of a Solute Carrier Family Member

The present invention also provides methods of inhibiting expression of a solute carrier family member gene, e.g., an SLC30A10 gene or an SLC39A8 gene, in a cell. The methods include contacting a cell with an RNAi agent, e.g., double stranded RNA agent, in an amount effective to inhibit expression of a solute carrier family member gene, e.g., an SLC30A10 gene or an SLC39A8 gene, in the cell, thereby inhibiting expression of the solute carrier family member, e.g., SLC30A10 or SLC39A8, in the cell.

Contacting of a cell with an iRNA, e.g., a double stranded RNA agent, may be done in vitro or in vivo. Contacting a cell in vivo with the iRNA includes contacting a cell or group of cells within a subject, e.g., a human subject, with the iRNA. Combinations of in vitro and in vivo methods of contacting a cell are also possible. Contacting a cell may be direct or indirect, as discussed above. Furthermore, contacting a cell may be accomplished via a targeting ligand, including any ligand described herein or known in the art. In preferred embodiments, the targeting ligand is a carbohydrate moiety, e.g., a GalNAc$_3$ ligand, or any other ligand that directs the RNAi agent to a site of interest.

The term "inhibiting," as used herein, is used interchangeably with "reducing," "silencing," "downregulating", "suppressing", and other similar terms, and includes any level of inhibition.

The phrase "inhibiting expression of a solute carrier family member" is intended to refer to inhibition of expression of any solute carrier family member gene, e.g., any SLC30A10 gene or any SLC39A8 gene, (such as, e.g., a mouse SLC30A10 gene, a rat SLC30A10 gene, a monkey SLC30A10 gene, or a human SLC30A10 gene; a mouse SLC39A8 gene, a rat SLC39A8 gene, a monkey SLC39A8 gene, or a human SLC39A8 gene) as well as variants or mutants of a solute carrier family member gene, e.g., an SLC30A10 gene or an SLC39A8 gene. Thus, the solute carrier family member gene may be a wild-type gene, a mutant gene, or a transgenic gene in the context of a genetically manipulated cell, group of cells, or organism.

"Inhibiting expression of a solute carrier family member gene" includes any level of inhibition of a solute carrier family member gene, e.g., an SLC30A10 gene or an SLC39A8 gene, e.g., at least partial suppression of the expression of a solute carrier family member gene, e.g., an SLC30A10 gene or an SLC39A8 gene. The expression of the solute carrier family member gene, e.g., the SLC30A10 gene or the SLC39A8 gene, may be assessed based on the level, or the change in the level, of any variable associated with the solute carrier family member gene gene expression, e.g., SLC30A10 mRNA level, SLC30A10 protein level, SLC39A8 mRNA level, or SLC39A8 protein level. This level may be assessed in an individual cell or in a group of cells, including, for example, a sample derived from a subject, such as a serum, liver, lung, prostate, brain, kidney, colon, thyroid Inhibition may be assessed by a decrease in an absolute or relative level of one or more variables that are associated with solute carrier family member expression compared with a control level. The control level may be any type of control level that is utilized in the art, e.g., a pre-dose baseline level, or a level determined from a similar subject, cell, or sample that is untreated or treated with a control (such as, e.g., buffer only control or inactive agent control).

In some embodiments of the methods of the invention, expression of a solute carrier family member gene, e.g., an SLC30A10 gene or an SLC39A8 gene, is inhibited by at least 50%, 55%, 60%, 65%, 70%, 75%, 80%, 85%, 90%, or 95%, or to below the level of detection of the assay. In preferred embodiments, expression of a solute carrier family member gene, e.g., an SLC30A10 gene or an SLC39A8 gene, is inhibited by at least 70%. It is further understood that inhibition of expression of a solute carrier family member, e.g., SLC30A10 or SLC39A8, in certain tissues, e.g., in liver, without a significant inhibition of expression in other tissues, e.g., brain, may be desirable. In preferred embodiments, expression level is determined using the assay method provided in Example 2 with a 10 nM siRNA concentration in the appropriate species matched cell line.

In certain embodiments, inhibition of expression in vivo is determined by knockdown of the human gene in a rodent expressing the human gene, e.g., an AAV-infected mouse expressing the human target gene (i.e., a solute carrier family member gene, e.g., an SLC30A10 gene or an SLC39A8 gene), e.g., when administered a single dose at, e.g., 3 mg/kg at the nadir of RNA expression. Knockdown of expression of an endogenous gene in a model animal system can also be determined, e.g., after administration of a single dose at 3 mg/kg at the nadir of RNA expression. Such systems are useful when the nucleic acid sequence of the human gene and the model animal gene are sufficiently close such that the human iRNA provides effective knockdown of the model animal gene. RNA expression in liver is determined using the PCR methods provided in Example 2.

Inhibition of the expression of a solute carrier family member gene, e.g., an SLC30A10 gene or an SLC39A8 gene, may be manifested by a reduction of the amount of mRNA expressed by a first cell or group of cells (such cells may be present, for example, in a sample derived from a subject) in which a solute carrier family member gene, e.g., an SLC30A10 gene or an SLC39A8 gene, is transcribed and which has or have been treated (e.g., by contacting the cell or cells with an iRNA of the invention, or by administering an iRNA of the invention to a subject in which the cells are or were present) such that the expression of a solute carrier family member gene, e.g., an SLC30A10 gene or an SLC39A8 gene, is inhibited, as compared to a second cell or group of cells substantially identical to the first cell or group of cells but which has not or have not been so treated (control cell(s) not treated with an iRNA or not treated with an iRNA targeted to the gene of interest). In preferred embodiments, the inhibition is assessed by the method provided in Example 2 using a 10 nM siRNA concentration in the species matched cell line and expressing the level of mRNA in treated cells as a percentage of the level of mRNA in control cells, using the following formula:

$$\frac{(mRNA \text{ in control cells}) - (mRNA \text{ in treated cells})}{(mRNA \text{ in control cells})} \cdot 100\%$$

In other embodiments, inhibition of the expression of a solute carrier family member gene, e.g., an SLC30A10 gene or an SLC39A8 gene, may be assessed in terms of a reduction of a parameter that is functionally linked to gene expression, e.g., protein level of a solute carrier family member, e.g., SLC30A10 or an SLC39A8, in blood or serum from a subject. Gene silencing of a solute carrier family member, e.g., SLC30A10 or SLC39A8, may be determined in any cell expressing the solute carrier family member, e.g., SLC30A10 or SLC39A8, either endogenous or heterologous from an expression construct, and by any assay known in the art.

Inhibition of the expression of a solute carrier family member protein, e.g., an SLC30A10 protein or an SLC39A8 protein, may be manifested by a reduction in the level of protein that is expressed by a cell or group of cells or in a subject sample (e.g., the level of protein in a blood sample derived from a subject). As explained above, for the assessment of mRNA suppression, the inhibition of protein expression levels in a treated cell or group of cells may similarly be expressed as a percentage of the level of protein in a control cell or group of cells, or the change in the level of protein in a subject sample, e.g., urine, blood or serum derived therefrom.

A control cell, a group of cells, or subject sample that may be used to assess the inhibition of the expression of a solute carrier family member gene, e.g., an SLC30A10 gene or an SLC39A8 gene, includes a cell, group of cells, or subject sample that has not yet been contacted with an RNAi agent of the invention. For example, the control cell, group of cells, or subject sample may be derived from an individual subject (e.g., a human or animal subject) prior to treatment of the subject with an RNAi agent or an appropriately matched population control.

The level of a solute carrier family member mRNA, e.g., an SLC30A10 mRNA or an SLC39A8 mRNA, that is expressed by a cell or group of cells may be determined using any method known in the art for assessing mRNA expression. In one embodiment, the level of expression of the solute carrier family member, e.g., SLC30A10 or SLC39A8, in a sample is determined by detecting a transcribed polynucleotide, or portion thereof, e.g., mRNA of the SLC30A10 gene or mRNA of the SLC39A8 gene. RNA may be extracted from cells using RNA extraction techniques including, for example, using acid phenol/guanidine isothiocyanate extraction (RNAzol B; Biogenesis), RNeasy™ RNA preparation kits (Qiagen®) or PAXgene™ (PreAnalytix™, Switzerland). Typical assay formats utilizing ribonucleic acid hybridization include nuclear run-on assays, RT-PCR, RNase protection assays, northern blotting, in situ hybridization, and microarray analysis.

In some embodiments, the level of expression of solute carrier family member, e.g., SLC30A10 or SLC39A8, is determined using a nucleic acid probe. The term "probe", as used herein, refers to any molecule that is capable of selectively binding to a specific solute carrier family member, e.g., SLC30A10 or SLC39A8. Probes can be synthesized by one of skill in the art, or derived from appropriate biological preparations. Probes may be specifically designed to be labeled. Examples of molecules that can be utilized as probes include, but are not limited to, RNA, DNA, proteins, antibodies, and organic molecules.

Isolated mRNA can be used in hybridization or amplification assays that include, but are not limited to, Southern or northern analyses, polymerase chain reaction (PCR) analyses and probe arrays. One method for the determination of mRNA levels involves contacting the isolated mRNA with a nucleic acid molecule (probe) that can hybridize to a solute carrier family member mRNA, e.g., SLC30A10 mRNA or SLC39A8 mRNA. In one embodiment, the mRNA is immobilized on a solid surface and contacted with a probe, for example by running the isolated mRNA on an agarose gel and transferring the mRNA from the gel to a membrane, such as nitrocellulose. In an alternative embodiment, the probe(s) are immobilized on a solid surface and the mRNA is contacted with the probe(s), for example, in an Affymetrix® gene chip array. A skilled artisan can readily adapt known mRNA detection methods for use in determining the level of a solute carrier family member mRNA, e.g., SLC30A10 mRNA or SLC39A8 mRNA.

An alternative method for determining the level of expression of a solute carrier family member, e.g., SLC30A10 or SLC39A8, in a sample involves the process of nucleic acid amplification or reverse transcriptase (to prepare cDNA) of for example mRNA in the sample, e.g., by RT-PCR (the experimental embodiment set forth in Mullis, 1987, U.S. Pat. No. 4,683,202), ligase chain reaction (Barany (1991) *Proc. Natl. Acad. Sci. USA* 88:189-193), self sustained sequence replication (Guatelli et al. (1990) *Proc. Natl. Acad. Sci. USA* 87:1874-1878), transcriptional amplification system (Kwoh et al. (1989) *Proc. Natl. Acad. Sci. USA* 86:1173-1177), Q-Beta Replicase (Lizardi et al. (1988) *Bio/Technology* 6:1197), rolling circle replication (Lizardi et al., U.S. Pat. No. 5,854,033) or any other nucleic acid amplification method, followed by the detection of the amplified molecules using techniques well known to those of skill in the art. These detection schemes are especially useful for the detection of nucleic acid molecules if such molecules are present in very low numbers. In particular aspects of the invention, the level of expression of a solute carrier family member, e.g., SLC30A10 or SLC39A8, is determined by quantitative fluorogenic RT-PCR (i.e., the TaqMan™ System). In preferred embodiments, expression level is determined by the method provided in Example 2 using, e.g., a 10 nM siRNA concentration, in the species matched cell line.

The expression levels of a solute carrier family member mRNA, e.g., SLC30A10 mRNA or SLC39A8 mRNA, may be monitored using a membrane blot (such as used in hybridization analysis such as northern, Southern, dot, and the like), or microwells, sample tubes, gels, beads or fibers (or any solid support comprising bound nucleic acids). See U.S. Pat. Nos. 5,770,722, 5,874,219, 5,744,305, 5,677,195 and 5,445,934, which are incorporated herein by reference. The determination of solute carrier family member expression level may also comprise using nucleic acid probes in solution.

In preferred embodiments, the level of mRNA expression is assessed using branched DNA (bDNA) assays or real time PCR (qPCR). The use of these methods is described and exemplified in the Examples presented herein. In preferred embodiments, expression level is determined by the method provided in Example 2 using a 10 nM siRNA concentration in the species matched cell line.

The level of protein expression of a solute carrier family member, e.g., SLC30A10 or SLC39A8, may be determined using any method known in the art for the measurement of protein levels. Such methods include, for example, electrophoresis, capillary electrophoresis, high performance liquid chromatography (HPLC), thin layer chromatography (TLC), hyperdiffusion chromatography, fluid or gel precipitin reactions, absorption spectroscopy, a colorimetric assays, spectrophotometric assays, flow cytometry, immunodiffusion (single or double), immunoelectrophoresis, western blotting, radioimmunoassay (RIA), enzyme-linked immunosorbent assays (ELISAs), immunofluorescent assays, electrochemiluminescence assays, and the like.

In some embodiments, the efficacy of the methods of the invention are assessed by a decrease in mRNA or protein level of a solute carrier family member, e.g., SLC30A10 or SLC39A8 (e.g., in a liver biopsy).

In some embodiments of the methods of the invention, the iRNA is administered to a subject such that the iRNA is delivered to a specific site within the subject. The inhibition of expression of a solute carrier family member, e.g., SLC30A10 or SLC39A8, may be assessed using measurements of the mRNA or protein level or change in the mRNA or protein level of a solute carrier family member, e.g., SLC30A10 or SLC39A8, in a sample derived from fluid or tissue from the specific site within the subject (e.g., liver, urine, or blood).

As used herein, the terms detecting or determining a level of an analyte are understood to mean performing the steps to determine if a material, e.g., protein, RNA, is present. As used herein, methods of detecting or determining include detection or determination of an analyte level that is below the level of detection for the method used.

VII. Prophylactic and Treatment Methods of the Invention

The present invention also provides methods of using an iRNA of the invention or a composition containing an iRNA of the invention to inhibit expression of a solute carrier family member, e.g., SLC30A10 or SLC39A8, thereby preventing or treating a solute carrier family member-associated disorder, e.g., a hypermanganesemia, such as manganism. In the methods of the invention the cell may be contacted with the siRNA in vitro or in vivo, i.e., the cell may be within a subject.

A cell suitable for treatment using the methods of the invention may be any cell that expresses a solute carrier family member gene, e.g., an SLC30A10 gene or an SLC39A8 gene, for example, a liver cell, a brain cell, a lung cell, a prostate cell, or a kidney cell, but preferably a liver cell. A cell suitable for use in the methods of the invention may be a mammalian cell, e.g., a primate cell (such as a human cell, including human cell in a chimeric non-human animal, or a non-human primate cell, e.g., a monkey cell or a chimpanzee cell), or a non-primate cell. In certain embodiments, the cell is a human cell, e.g., a human liver cell. In the methods of the invention, expression of a solute carrier family member, e.g., SLC30A10 or SLC39A8, is inhibited in the cell by at least 50, 55, 60, 65, 70, 75, 80, 85, 90, or 95, or to a level below the level of detection of the assay.

The in vivo methods of the invention may include administering to a subject a composition containing an iRNA, where the iRNA includes a nucleotide sequence that is complementary to at least a part of an RNA transcript of the solute carrier family member gene, e.g., SLC30A10 gene or SLC39A8 gene, of the mammal to which the RNAi agent is to be administered. The composition can be administered by any means known in the art including, but not limited to oral, intraperitoneal, or parenteral routes, including intracranial (e.g., intraventricular, intraparenchymal, and intrathecal), intravenous, intramuscular, subcutaneous, transdermal, airway (aerosol), nasal, rectal, and topical (including buccal and sublingual) administration. In certain embodiments, the compositions are administered by intravenous infusion or injection. In certain embodiments, the compositions are administered by subcutaneous injection. In certain embodiments, the compositions are administered by intramuscular injection.

In one aspect, the present invention also provides methods for inhibiting the expression of a solute carrier family member gene, e.g., an SLC30A10 gene or an SLC39A8 gene, in a mammal. The methods include administering to the mammal a composition comprising a dsRNA that targets a solute carrier family member gene, e.g., an SLC30A10 gene or an SLC39A8 gene, in a cell of the mammal and maintaining the mammal for a time sufficient to obtain degradation of the mRNA transcript of the solute carrier family member gene, e.g., the SLC30A10 gene or the SLC39A8 gene, thereby inhibiting expression of the solute carrier family member gene, e.g., the SLC30A10 gene or the SLC39A8 gene, in the cell. Reduction in gene expression can be assessed by any methods known in the art and by methods, e.g. qRT-PCR, described herein, e.g., in Example 2. Reduction in protein production can be assessed by any methods known it the art, e.g. ELISA. In certain embodiments, a puncture liver biopsy sample serves as the tissue material for monitoring the reduction in the gene or protein expression of a solute carrier family member, e.g., SLC30A10 or SLC39A8. In other embodiments, a blood and/or urine sample serves as the subject sample for monitoring the reduction in the protein expression of a solute carrier family member, e.g., SLC30A10 or SLC39A8.

The present invention further provides methods of treatment in a subject in need thereof, e.g., a subject having, e.g., diagnosed with, a solute carrier family member-associated disorder, such as, a hypermanganesemia, e.g., manganism or hypermanganesemia with dystonia-1.

The present invention further provides methods of prophylaxis in a subject in need thereof. The treatment methods of the invention include administering an iRNA of the invention to a subject, e.g., a subject that would benefit from a reduction of a solute carrier family member expression, e.g., an SLC30A10 expression or an SLC39A8 expression, in a prophylactically effective amount of an iRNA targeting a solute carrier family member gene, e.g., an SLC30A10 gene or an SLC39A8 gene, or a pharmaceutical composition comprising an iRNA targeting a solute carrier family member gene, e.g., an SLC30A10 gene or an SLC39A8 gene.

In one embodiment, a solute carrier family member-associated disease, e.g., a SLC30A10-associated disease or a SLC39A8-associated disease, is a hypermanganesemia. In one embodiment, the hypermanganesemia is manganism. In another embodiment, the hypermanganesemia is hypermanganesemia with dystonia-1.

An iRNA of the invention may be administered as a "free iRNA." A free iRNA is administered in the absence of a pharmaceutical composition. The naked iRNA may be in a suitable buffer solution. The buffer solution may comprise acetate, citrate, prolamine, carbonate, or phosphate, or any combination thereof. In one embodiment, the buffer solution is phosphate buffered saline (PBS). The pH and osmolarity of the buffer solution containing the iRNA can be adjusted such that it is suitable for administering to a subject.

Alternatively, an iRNA of the invention may be administered as a pharmaceutical composition, such as a dsRNA liposomal formulation.

Subjects that would benefit from an inhibition of expression of a solute carrier family member gene, e.g., an SLC30A10 gene or an SLC39A8 gene, are subjects susceptible to or diagnosed with an solute carrier family member-associated disorder, such as a hypermanganesemia, e.g., manganism.

In some embodiment, such subjects do not have a mutation in an SLC39A14 gene (i.e., subjects having hypermanganesemia with dystonia-2), or such subjects have a mutation in an SLC30A10 gene (i.e., subjects having hypermanganesemia with dystonia-1).

Normal ranges of manganese levels in body fluids are 4-15 µg/L in blood, 1-8 µg/L in urine, and 0.4-0.85 µg/L in serum. Normal Mn concentrations in the liver are about 1 to 1.5 mg Mn/kg (wet weight). Subjects having an solute carrier family member-associated disorder, e.g., a SLV30A10-associate disease or a SLC39A8-associated disease, such as a hypermanganesemia, e.g., manganism, have levels of Mn greater than twice the upper limit of normal and have been environmentally (e.g., occupationally) exposed, e.g., chronically exposed, to excess Mn, such as chronic exposure to ambient manganese air concentrations greater than about 1 microgram Mn/m$^3$, have consumed high amounts of manganese supplements for several years, or have consumed water containing high levels of manganese, e.g, greater than about 1.8 mg Mn/L. Such subjects have generally been exposed to excess Mn through mining, welding, ferromanganese smelting, industrial and agricultural work, chronic liver failure with cirrhosis (acquired hepatolenticular degeneration), total parenteral nutrition, and ingestion of Chinese herbal pills.

Subjects at subjects at risk of developing a hypermanganesemia, e.g., manganism, are those subjects environmentally (e.g., occupationally) exposed, to excess Mn through mining, welding, ferromanganese smelting, industrial and agricultural work, chronic liver failure with cirrhosis (acquired hepatolenticular degeneration), total parenteral nutrition, and ingestion of Chinese herbal pills.

In other embodiments, the subject that would benefit from an inhibition of expression of a solute carrier family member gene, e.g., an SLC30A10 gene or an SLC39A8 gene, are subjects susceptible to or diagnosed with a solute carrier family member-associated disorder, such as a hypermanganesemia, e.g., subjects having a mutation in an SLC39A14 gene (i.e., subjects having hypermanganesemia with dystonia-2), or subjects having a mutation in an SLC30A10 gene (i.e., subjects having hypermanganesemia with dystonia-1).

In an embodiment, the method includes administering a composition featured herein such that expression of the target solute carrier family member gene, e.g., an SLC30A10 gene or an SLC39A8 gene, is decreased, such as for about 1, 2, 3, 4, 5, 6, 1-6, 1-3, or 3-6 months per dose. In certain embodiments, the composition is administered once every 3-6 months.

Preferably, the iRNAs useful for the methods and compositions featured herein specifically target RNAs (primary or processed) of the target solute carrier family member gene, e.g., an SLC30A10 gene or an SLC39A8 gene. Compositions and methods for inhibiting the expression of these genes using iRNAs can be prepared and performed as described herein.

Administration of the iRNA according to the methods of the invention may result prevention or treatment of a solute carrier family member-associated disorder, such as a SLC30A10-associated disease or a SLC39A8-associated disease, e.g., a hypermanganesemia.

Subjects can be administered a therapeutic amount of iRNA, such as about 0.01 mg/kg to about 200 mg/kg.

The iRNA is preferably administered subcutaneously, i.e., by subcutaneous injection. One or more injections may be used to deliver the desired dose of iRNA to a subject. The injections may be repeated over a period of time.

The administration may be repeated on a regular basis. In certain embodiments, after an initial treatment regimen, the treatments can be administered on a less frequent basis. A repeat-dose regimen may include administration of a therapeutic amount of iRNA on a regular basis, such as once per month to once a year. In certain embodiments, the iRNA is administered about once per month to about once every three months, or about once every three months to about once every six months.

The invention further provides methods and uses of an iRNA agent or a pharmaceutical composition thereof for treating a subject that would benefit from reduction and/or inhibition of gene expression of a solute carrier family member, e.g., SLC30A10 or SLC39A8, e.g., a subject having an solute carrier family member-associated disease, such as a SLC-30A10-associated disease or a SLC39A8-associated disease, in combination with other pharmaceuticals and/or other therapeutic methods, e.g., with known pharmaceuticals and/or known therapeutic methods, such as, for example, those which are currently employed for treating these disorders.

Accordingly, in some aspects of the invention, the methods which include either a single iRNA agent of the invention, further include administering to the subject one or more additional therapeutic agents.

The iRNA agent and an additional therapeutic agent and/or treatment may be administered at the same time and/or in the same combination, e.g., parenterally, or the additional therapeutic agent can be administered as part of a separate composition or at separate times and/or by another method known in the art or described herein.

For example, additional therapeutics and therapeutic methods suitable for treating a subject that would benefit from reduction in expression of a solute carrier family member gene, e.g., an SLC30A10 gene or an SLC39A8 gene, e.g., a subject having a solute carrier family member-associated disease, such as a SLC30A10-associated disease or a SLC39A8-associated disease, include intravenous calcium edetate, supplementation with oral iron, antipasticity medications, levodopa, physiotherapy, and liver transplantation for subjects having end-stage liver disease.

VIII. Kits

The present invention also provides kits for performing any of the methods of the invention. Such kits include one or more dsRNA agent(s) and instructions for use, e.g., instructions for administering a prophylactically or therapeutically effective amount of a dsRNA agent(s). The dsRNA agent may be in a vial or a pre-filled syringe. The kits may optionally further comprise means for administering the dsRNA agent (e.g., an injection device, such as a syringe), or means for measuring the inhibition of a solute carrier family member, e.g., SLC30A10 or SLC39A8, (e.g., means for measuring the inhibition of the mRNA level of a solute carrier family member, e.g., SLC30A10 or SLC39A8, means for measuring the inhibition of the protein level of a solute carrier family member, e.g., SLC30A10 or SLC39A8, and/or means for measuring the activity of a solute carrier family member, e.g., SLC30A10 or SLC39A8 (e.g., whole blood Mn levels)). Such means for measuring the inhibition of a solute carrier family member, e.g., SLC30A10 or SLC39A8, may comprise a means for obtaining a sample from a subject, such as, e.g., a plasma sample. The kits of the invention may optionally further comprise means for determining the therapeutically effective or prophylactically effective amount.

This invention is further illustrated by the following examples which should not be construed as limiting. The entire contents of all references, patents and published patent applications cited throughout this application, as well as the informal Sequence Listing and Figures, are hereby incorporated herein by reference.

EXAMPLES

Example 1. iRNA Synthesis

Source of Reagents

Where the source of a reagent is not specifically given herein, such reagent can be obtained from any supplier of reagents for molecular biology at a quality/purity standard for application in molecular biology.

siRNA Design siRNAs targeting the human solute carrier family 30 member 10 (SLC30A10) gene (human: NCBI refseqID NM_018713.2; NCBI GeneID: 55532) were designed using custom Rand Python scripts. The human NM_018713.2 REFSEQ mRNA, has a length of 2869 bases.

A detailed list of the unmodified SLC30A10 sense and antisense strand nucleotide sequences are shown in Table 2. A detailed list of the modified SLC30A10 sense and antisense strand nucleotide sequences are shown in Table 3.

siRNAs targeting the human solute carrier family 39 member 8 (SLC39A8) gene (human: NCBI refseqID NM_001135146.2; NCBI GeneID: 64116) were designed using custom Rand Python scripts. The human NM_001135146.2 REFSEQ mRNA, has a length of 3,152 bases.

siRNAs targeting the mouse solute carrier family 39 member 8 (SLC39A8) gene (mouse: NCBI refseqID NM_026228.5; NCBI GeneID: 67547) were also designed using custom R and Python scripts. The mouse NM_026228.5 REFSEQ mRNA, has a length of 3,492 bases.

A detailed list of the unmodified SLC39A8 sense and antisense strand nucleotide sequences are shown in Tables 4, 6 and 8. A detailed list of the modified SLC39A8 sense and antisense strand nucleotide sequences are shown in Tables 5, 7 and 9.

It is to be understood that, throughout the application, a duplex name without a decimal is equivalent to a duplex name with a decimal which merely references the batch number of the duplex. For example, AD-564727 is equivalent to AD-564727.1.

siRNA Synthesis siRNAs were synthesized and annealed using routine methods known in the art.

Briefly, siRNA sequences were synthesized on a 1 μmol scale using a Mermade 192 synthesizer (BioAutomation) with phosphoramidite chemistry on solid supports. The solid support was controlled pore glass (500-1000 Å) loaded with a custom GalNAc ligand (3'-GalNAc conjugates), universal solid support (AM Chemicals), or the first nucleotide of interest. Ancillary synthesis reagents and standard 2-cyanoethyl phosphoramidite monomers (2'-deoxy-2'-fluoro, 2'-O-methyl, RNA, DNA) were obtained from Thermo-Fisher (Milwaukee, WI), Hongene (China), or Chemgenes (Wilmington, MA, USA). Additional phosphoramidite monomers were procured from commercial suppliers, prepared in-house, or procured using custom synthesis from various CMOs. Phosphoramidites were prepared at a concentration of 100 mM in either acetonitrile or 9:1 acetonitrile:DMF and were coupled using 5-Ethylthio-1H-tetrazole (ETT, 0.25 M in acetonitrile) with a reaction time of 400 s. Phosphorothioate linkages were generated using a 100 mM solution of 3-((Dimethylamino-methylidene)amino)-3H-1,2,4-dithiazole-3-thione (DDTT, obtained from Chemgenes (Wilmington, MA, USA)) in anhydrous acetonitrile/pyridine (9:1 v/v). Oxidation time was 5 minutes. All sequences were synthesized with final removal of the DMT group ("DMT-Off").

Upon completion of the solid phase synthesis, solid-supported oligoribonucleotides were treated with 300 μL of Methylamine (40% aqueous) at room temperature in 96 well plates for approximately 2 hours to afford cleavage from the solid support and subsequent removal of all additional base-labile protecting groups. For sequences containing any natural ribonucleotide linkages (2'-OH) protected with a tert-butyl dimethyl silyl (TBDMS) group, a second deprotection step was performed using TEA·3HF (triethylamine trihydrofluoride). To each oligonucleotide solution in aqueous methylamine was added 200 µL of dimethyl sulfoxide (DMSO) and 300 µL TEA·3HF and the solution was incubated for approximately 30 mins at 60° C. After incubation, the plate was allowed to come to room temperature and crude oligonucleotides were precipitated by the addition of 1 mL of 9:1 acetontrile:ethanol or 1:1 ethanol:isopropanol. The plates were then centrifuged at 4° C. for 45 mins and the supernatant carefully decanted with the aid of a multichannel pipette. The oligonucleotide pellet was resuspended in 20 mM NaOAc and subsequently desalted using a HiTrap size exclusion column (5 mL, GE Healthcare) on an Agilent LC system equipped with an autosampler, UV detector, conductivity meter, and fraction collector. Desalted samples were collected in 96 well plates and then analyzed by LC-MS and UV spectrometry to confirm identity and quantify the amount of material, respectively.

Duplexing of single strands was performed on a Tecan liquid handling robot. Sense and antisense single strands were combined in an equimolar ratio to a final concentration of 10 µM in 1×PBS in 96 well plates, the plate sealed, incubated at 100° C. for 10 minutes, and subsequently allowed to return slowly to room temperature over a period of 2-3 hours. The concentration and identity of each duplex was confirmed and then subsequently utilized for in vitro screening assays.

Example 2. In Vitro Screening Methods

In Vitro Dual-Luciferase and Endogenous Screening Assays

Cos-7 cells (ATCC, Manassas, VA) were grown to near confluence at 37° C. in an atmosphere of 5% $CO_2$ in DMEM (ATCC) supplemented with 10% FBS, before being released from the plate by trypsinization. Single-dose experiments were performed at 50 nM, 10 nM, 1 nM, and 0.1 nM. siRNA and psiCHECK2-SLC39A8 plasmid transfections were carried out with a plasmid containing the full length transcript of the SLC39A8 gene (GenBank Accession No. NM_001135146.2). Transfection was carried out by adding 5 µL of siRNA duplexes and 5 µL (5 ng) of psiCHECK2 plasmid per well along with 4.9 µL of Opti-MEM plus 0.1 µL of Lipofectamine 2000 per well (Invitrogen, Carlsbad CA. cat #13778-150) and then incubated at room temperature for 15 minutes. The mixture was then added to the cells which are re-suspended in 35 µL of fresh complete media. The transfected cells were incubated at 37° C. in an atmosphere of 5% $CO_2$.

Forty-eight hours after the siRNAs and psiCHECK2 plasmid are transfected; Firefly (transfection control) and Renilla (fused to SLC39A8 target sequence) luciferase were measured. First, media was removed from cells. Then Firefly luciferase activity was measured by adding 20 µL of Dual-Glo® Luciferase Reagent equal to the culture medium volume to each well and mix. The mixture was incubated at room temperature for 30 minutes before luminescense (500 nm) was measured on a Spectramax (Molecular Devices) to detect the Firefly luciferase signal. Renilla luciferase activity was measured by adding 20 µL of room temperature of Dual-Glo® Stop & Glo® Reagent to each well and the plates were incubated for 10-15 minutes before luminescence was again measured to determine the Renilla luciferase signal. The Dual-Glo® Stop & Glo® Reagent quenches the firefly luciferase signal and sustained luminescence for the Renilla luciferase reaction. siRNA activity was determined by normalizing the Renilla (SLC39A8) signal to the Firefly (control) signal within each well. The magnitude of siRNA activity was then assessed relative to cells that were transfected with the same vector but were not treated with siRNA or were treated with a non-targeting siRNA. All transfections were done with n=4.

Cell Culture and Transfections

Cells were transfected by adding 4.9 µL of Opti-MEM plus 0.1 µL of RNAiMAX per well (Invitrogen, Carlsbad CA. cat #13778-150) to 5 µL of siRNA duplexes per well, with 4 replicates of each siRNA duplex, into a 384-well plate, and incubated at room temperature for 15 minutes. Forty µL of MEDIA containing ~5×$10^3$ cells were then added to the siRNA mixture. Cells were incubated for 24 hours prior to RNA purification. Experiments were performed at 50 nM, 10 nM, 1 nM, and 0.1 nM. Transfection experiments were performed in Cos7 cells.

Cell Culture and 384-Well Transfections

Primary mouse hepatocytes (PMH) freshly isolated less than 1 hour prior to transfections and grown in primary hepatocyte media. Hep3B cells were grown in appropriate media. Transfection was carried out by adding 14.8 µl of Opti-MEM plus 0.2 µl of Lipofectamine RNAiMax per well (Invitrogen, Carlsbad CA. cat #13778-150) to 5 µl of each siRNA duplex to an individual well in a 96-well plate. The mixture was then incubated at room temperature for 15 minutes. Eighty l of complete growth media without antibiotic containing ~2×$10^4$ cells were then added to the siRNA mixture. Cells were incubated for 24 hours prior to RNA purification. Single dose experiments in PMH were performed at 50 nM, 10 nM, 1 nM, and 0.1 nM final duplex concentration. Single dose experiments in Hep3B cells were performed at 50 nM final duplex concentration.

Total RNA isolation using DYNABEADS mRNA Isolation Kit (Invitrogen™, part #: 610-12)

Cells were lysed in 75 µl of Lysis/Binding Buffer containing 3 µL of beads per well and mixed for 10 minutes on an electrostatic shaker. The washing steps were automated on a Biotek EL406, using a magnetic plate support. Beads were washed (in 90 L) once in Buffer A, once in Buffer B, and twice in Buffer E, with aspiration steps in between. Following a final aspiration, complete 10 µL RT mixture was added to each well, as described below.

cDNA Synthesis Using ABI High Capacity cDNA Reverse Transcription Kit (Applied Biosystems, Foster City, CA, Cat #4368813)

A master mix of 1 µl 10× Buffer, 0.4 µl 25×dNTPs, 1 µl Random primers, 0.5 l Reverse Transcriptase, 0.5 µl RNase inhibitor and 6.6 µl of $H_2O$ per reaction were added per well. Plates were sealed, agitated for 10 minutes on an electrostatic shaker, and then incubated at 37 degrees C. for 2 hours. Following this, the plates were agitated at 80 degrees C. for 8 minutes.

Real Time PCR

Two microlitre (µl) of cDNA were added to a master mix containing 0.5 µl of human GAPDH TaqMan Probe (4326317E), 0.5 µl human SLC30A10 or SLC39A8 probe, 2 µl nuclease-free water and 5 µl Lightcycler 480 probe master mix (Roche Cat #04887301001) per well in a 384 well plates (Roche cat #04887301001). Real time PCR was done in a LightCycler480 Real Time PCR system (Roche).

To calculate relative fold change, data were analyzed using the ΔΔCt method and normalized to assays performed with cells transfected with 10 nM AD-1955, or mock transfected cells. $IC_{50}$S were calculated using a 4 parameter fit model using XLFit and normalized to cells transfected with AD-1955 or mock-transfected. The sense and antisense sequences of AD-1955 are: sense: cuuAcGcuGAGuAcuucGAdTsdT (SEQ ID NO: 23) and antisense UCGA-AGuACUcAGCGuAAGdTsdT (SEQ ID NO: 24).

The results of a single dose screen of the agents provided in Tables 2 and 3 in Hep3B cells is provided in Table 13.

The results of a single dose screen of the agents provided in Tables 8 and 9 in Primary Mouse Hepatocytes (PMH) is provided in Table 10.

The results of a single dose screen of the agents provided in Tables 8 and 9 in Cos7 cells is provided in Table 11.

The results of a single dose screen of the agents provided in Tables 6 and 7 in Primary Mouse Hepatocytes (PMH) is provided in Table 12.

TABLE 1

Abbreviations of nucleotide monomers used in nucleic acid sequence representation. It will be understood that these monomers, when present in an oligonucleotide, are mutually linked by 5'-3'-phosphodiester bonds.

| Abbreviation | Nucleotide(s) |
|---|---|
| A | Adenosine-3'-phosphate |
| Ab | beta-L-adenosine-3'-phosphate |
| Abs | beta-L-adenosine-3'-phosphorothioate |
| Af | 2'-fluoroadenosine-3'-phosphate |
| Afs | 2'-fluoroadenosine-3'-phosphorothioate |
| As | adenosine-3'-phosphorothioate |
| C | cytidine-3'-phosphate |
| Cb | beta-L-cytidine-3'-phosphate |
| Cbs | beta-L-cytidine-3'-phosphorothioate |
| Cf | 2'-fluorocytidine-3'-phosphate |
| Cfs | 2'-fluorocytidine-3'-phosphorothioate |
| Cs | cytidine-3'-phosphorothioate |
| G | guanosine-3'-phosphate |
| Gb | beta-L-guanosine-3'-phosphate |
| Gbs | beta-L-guanosine-3'-phosphorothioate |
| Gf | 2'-fluoroguanosine-3'-phosphate |
| Gfs | 2'-fluoroguanosine-3'-phosphorothioate |
| Gs | guanosine-3'-phosphorothioate |
| T | 5'-methyluridine-3'-phosphate |
| Tf | 2'-fluoro-5-methyluridine-3'-phosphate |
| Tfs | 2'-fluoro-5-methyluridine-3'-phosphorothioate |
| Ts | 5-methyluridine-3'-phosphorothioate |
| U | Uridine-3'-phosphate |
| Uf | 2'-fluorouridine-3'-phosphate |
| Ufs | 2'-fluorouridine-3'-phosphorothioate |
| Us | uridine-3'-phosphorothioate |
| N | any nucleotide, modified or unmodified |
| a | 2'-O-methyladenosine-3'-phosphate |
| as | 2'-O-methyladenosine-3'-phosphorothioate |

TABLE 1-continued

Abbreviations of nucleotide monomers used in nucleic acid sequence representation. It will be understood that these monomers, when present in an oligonucleotide, are mutually linked by 5'-3'-phosphodiester bonds.

| Abbreviation | Nucleotide(s) |
|---|---|
| c | 2'-O-methylcytidine-3'-phosphate |
| cs | 2'-O-methylcytidine-3'-phosphorothioate |
| g | 2'-O-methylguanosine-3'-phosphate |
| gs | 2'-O-methylguanosine-3'-phosphorothioate |
| t | 2'-O-methyl-5-methyluridine-3'-phosphate |
| ts | 2'-O-methyl-5-methyluridine-3'-phosphorothioate |
| u | 2'-O-methyluridine-3'-phosphate |
| us | 2'-O-methyluridine-3'-phosphorothioate |
| s | phosphorothioate linkage |
| L10 | N-(cholesterylcarboxamidocaproyl)-4-hydroxyprolinol (Hyp-C6-Chol) |
| L96 | N-[tris(GalNAc-alkyl)-amidodecanoyl)]-4-hydroxyprolinol (Hyp-(GalNAc-alkyl)3) |
| Y34 | 2-hydroxymethyl-tetrahydrofurane-4-methoxy-3-phosphate (abasic 2'-OMe furanose) |
| Y44 | inverted abasic DNA (2-hydroxymethyl-tetrahydrofurane-5-phosphate) |
| (Agn) | Adenosine-glycol nucleic acid (GNA) |
| (Cgn) | Cytidine-glycol nucleic acid (GNA) |
| (Ggn) | Guanosine-glycol nucleic acid (GNA) |
| (Tgn) | Thymidine-glycol nucleic acid (GNA) S-Isomer |
| P | Phosphate |
| VP | Vinyl-phosphonate |
| dA | 2'-deoxyadenosine-3'-phosphate |
| dAs | 2'-deoxyadenosine-3'-phosphorothioate |
| dC | 2'-deoxycytidine-3'-phosphate |
| dCs | 2'-deoxycytidine-3'-phosphorothioate |
| dG | 2'-deoxyguanosine-3'-phosphate |
| dGs | 2'-deoxyguanosine-3'-phosphorothioate |
| dT | 2'-deoxythymidine-3'-phosphate |
| dTs | 2'-deoxythymidine-3'-phosphorothioate |
| dU | 2'-deoxyuridine |
| dUs | 2'-deoxyuridine-3'-phosphorothioate |
| (C2p) | cytidine-2'-phosphate |
| (G2p) | guanosine-2'-phosphate |
| (U2p) | uridine-2'-phosphate |
| (A2p) | adenosine-2'-phosphate |
| (Chd) | 2'-O-hexadecyl-cytidine-3'-phosphate |
| (Ahd) | 2'-O-hexadecyl-adenosine-3'-phosphate |
| (Ghd) | 2'-O-hexadecyl-guanosine-3'-phosphate |
| (Uhd) | 2'-O-hexadecyl-uridine-3'-phosphate |

TABLE 2

Unmodified Sense and Antisense Strand Sequences of Solute Carrier Family 30 Member 10 (SLC30A10) dsRNA Agents

| Duplex ID | Sense Sequence 5' to 3' | SEQ ID NO: | Antisense Sequence 5'-3' | SEQ ID NO: | Target mRNA Start Position in NM_018713.2 | Target mRNA End Position in NM_018713.2 |
|---|---|---|---|---|---|---|
| AD-1023162 | CCACUCCUUUAGACUCUGG | 25 | CCAGAGUCUAAAGGAGUGG | 160 | 11 | 29 |
| AD-1023184 | CGCGUUAUAAAAAGCGGUG | 26 | CACCGCUUUUUAUAACGCG | 161 | 58 | 76 |
| AD-1023195 | GGCGAGACAAUCUGGGAGG | 27 | CCUCCCAGAUUGUCUCGCC | 162 | 87 | 105 |
| AD-1023230 | GCUACUCUGGCAAGACGUG | 28 | CACGUCUUGCCAGAGUAGC | 163 | 219 | 237 |
| AD-1023255 | GCUCUUCAUGCUGGUGCUC | 29 | GAGCACCAGCAUGAAGAGC | 164 | 244 | 262 |
| AD-1023273 | CACCGUCGCCUUCUUCGUG | 30 | CACGAAGAAGGCGACGGUG | 165 | 262 | 280 |
| AD-1023313 | GGGCAACUCCAUCGCGCUG | 31 | CAGCGCGAUGGAGUUGCCC | 166 | 304 | 322 |
| AD-1023339 | ACUCCUUCAACAUGCUCUC | 32 | GAGAGCAUGUUGAAGGAGU | 167 | 330 | 348 |
| AD-1023357 | CCGACCUGAUCUCGCUGUG | 33 | CACAGCGAGAUCAGGUCGG | 168 | 348 | 366 |

TABLE 2-continued

Unmodified Sense and Antisense Strand Sequences of Solute Carrier Family 30 Member 10 (SLC30A10) dsRNA Agents

| Duplex ID | Sense Sequence 5' to 3' | SEQ ID NO: | Antisense Sequence 5'-3' | SEQ ID NO: | Target mRNA Start Position in NM_018713.2 | Target mRNA End Position in NM_018713.2 |
|---|---|---|---|---|---|---|
| AD-1023407 | CAACGCGGUCUUCCUCACC | 34 | GGUGAGGAAGACCGCGUUG | 169 | 463 | 481 |
| AD-1023429 | CUCUGCUUCACCAUCUUCG | 35 | CGAAGAUGGUGAAGCAGAG | 170 | 485 | 503 |
| AD-1023459 | GGUGCUCAUCGUCGGCGUC | 36 | GACGCCGACGAUGAGCACC | 171 | 556 | 574 |
| AD-1023467 | GCUGUUGGUCAACGUGGUG | 37 | CACCACGUUGACCAACAGC | 172 | 580 | 598 |
| AD-1023474 | UGCUCAUCUUCCAGGACUG | 38 | CAGUCCUGGAAGAUGAGCA | 173 | 603 | 621 |
| AD-1023488 | CCGCCUGGUUCGCGUGCUG | 39 | CAGCACGCGAACCAGGCGG | 174 | 624 | 642 |
| AD-1023526 | ACCUCGGUGGAAAGGAAGC | 40 | GCUUCCUUUCCACCGAGGU | 175 | 797 | 815 |
| AD-1023539 | ACCGUGUUCGCAAACGUAG | 41 | CUACGUUUGCGAACACGGU | 176 | 830 | 848 |
| AD-1023559 | AGGUGAUUCCUUCAACACC | 42 | GGUGUUGAAGGAAUCACCU | 177 | 850 | 868 |
| AD-1023575 | ACCCAGAAUGAGCCAGAAG | 43 | CUUCUGGCUCAUUCUGGGU | 178 | 866 | 884 |
| AD-1023588 | CAGAAGACAUGAUGAAAAA | 44 | UUUUUCAUCAUGUCUUCUG | 179 | 879 | 897 |
| AD-1023600 | AAGUCUGAAGCUCUGAAUA | 45 | UAUUCAGAGCUUCAGACUU | 180 | 905 | 923 |
| AD-1023612 | CUGAAUAUCAGAGGUGUAC | 46 | GUACACCUCUGAUAUUCAG | 181 | 917 | 935 |
| AD-1023624 | GGUGUACUUUUGCAUGUGA | 47 | UCACAUGCAAAAGUACACC | 182 | 929 | 947 |
| AD-1023646 | CGUGGUUGUGGUCAUCACG | 48 | CGUGAUGACCACAACCACG | 183 | 967 | 985 |
| AD-1023669 | UCAUAUUCUAUGUGCUUCC | 49 | GGAAGCACAUAGAAUAUGA | 184 | 990 | 1008 |
| AD-1023671 | CCCUGAAGAGUGAGGACCC | 50 | GGGUCCUCACUCUUCAGGG | 185 | 1008 | 1026 |
| AD-1023684 | GGACCCGUGUAACUGGCAG | 51 | CUGCCAGUUACACGGGUCC | 186 | 1021 | 1039 |
| AD-1023696 | CUGGCAGUGUUACAUUGAC | 52 | GUCAAUGUAACACUGCCAG | 187 | 1033 | 1051 |
| AD-1023707 | GACUGUCCUCAUGGUCAUC | 53 | GAUGACCAUGAGGACAGUC | 188 | 1060 | 1078 |
| AD-1023719 | GGUCAUCAUCAUUUUGUCA | 54 | UGACAAAAUGAUGAUGACC | 189 | 1072 | 1090 |
| AD-1023732 | UUGUCAUCUGCCUUCCCGC | 55 | GCGGGAAGGCAGAUGACAA | 190 | 1085 | 1103 |
| AD-1023745 | UCCCGCUUAUCAAGGAGAC | 56 | GUCUCCUUGAUAAGCGGGA | 191 | 1098 | 1116 |
| AD-1023767 | UGCCAUUCUGCUACAGAUG | 57 | CAUCUGUAGCAGAAUGGCA | 192 | 1120 | 1138 |
| AD-1023787 | UCCCAAAAGGAGUCAACAU | 58 | AUGUUGACUCCUUUUGGGA | 193 | 1140 | 1158 |
| AD-1023800 | CAACAUGGAAGAGCUGAUG | 59 | CAUCAGCUCUUCCAUGUUG | 194 | 1153 | 1171 |
| AD-1023812 | GCUGAUGAGUAAACUCUCU | 60 | AGAGAGUUUACUCAUCAGC | 195 | 1165 | 1183 |
| AD-1023837 | CCUGGAAUUAGCAGUGUAC | 61 | GUACACUGCUAAUUCCAGG | 196 | 1190 | 1208 |
| AD-1023849 | AGUGUACAUGAAGUGCACA | 62 | UGUGCACUUCAUGUACACU | 197 | 1202 | 1220 |
| AD-1023863 | GCACAUCUGGGAACUUGUA | 63 | UACAAGUUCCCAGAUGUGC | 198 | 1216 | 1234 |
| AD-1023876 | CUUGUAAGUGGAAAGAUUA | 64 | UAAUCUUUCCACUUACAAG | 199 | 1229 | 1247 |
| AD-1023888 | AAGAUUAUUGCCACCCUGC | 65 | GCAGGGUGGCAAUAAUCUU | 200 | 1241 | 1259 |
| AD-1023910 | UCAAGUAUCCUAAGGACAG | 66 | CUGUCCUUAGGAUACUUGA | 201 | 1263 | 1281 |
| AD-1023913 | GGGAUAUCAAGAUGCCAGC | 67 | GCUGGCAUCUUGAUAUCCC | 202 | 1282 | 1300 |
| AD-1023930 | GCACAAAAAUUCGAGAAAU | 68 | AUUUCUCGAAUUUUUGUGC | 203 | 1299 | 1317 |
| AD-1023942 | GAGAAAUCUUCCACCAUGC | 69 | GCAUGGUGGAAGAUUUCUC | 204 | 1311 | 1329 |

TABLE 2-continued

Unmodified Sense and Antisense Strand Sequences of Solute Carrier Family 30 Member 10 (SLC30A10) dsRNA Agents

| Duplex ID | Sense Sequence 5' to 3' | SEQ ID NO: | Antisense Sequence 5'-3' | SEQ ID NO: | Target mRNA Start Position in NM_018713.2 | Target mRNA End Position in NM_018713.2 |
|---|---|---|---|---|---|---|
| AD-1023964 | AAUCCACAAUGUGACCAUC | 70 | GAUGGUCACAUUGUGGAUU | 205 | 1333 | 1351 |
| AD-1023979 | CAUCCAGUUUGAAAAUGUG | 71 | CACAUUUUCAAACUGGAUG | 206 | 1348 | 1366 |
| AD-1023993 | AUGUGGACUUGAAGGAACC | 72 | GGUUCCUUCAAGUCCACAU | 207 | 1362 | 1380 |
| AD-1024002 | GCAGAAGGACUUACUGUUG | 73 | CAACAGUAAGUCCUUCUGC | 208 | 1387 | 1405 |
| AD-1024016 | UGUUGCUCUGCAACUCACC | 74 | GGUGAGUUGCAGAGCAACA | 209 | 1401 | 1419 |
| AD-1024030 | UCACCCUGCAUCUCCAAGG | 75 | CCUUGGAGAUGCAGGGUGA | 210 | 1415 | 1433 |
| AD-1024052 | GUGCUAAGCAGCUGUGUUG | 76 | CAACACAGCUGCUUAGCAC | 211 | 1437 | 1455 |
| AD-1024071 | GCUCACGUCAAUGGCUGUG | 77 | CACAGCCAUUGACGUGAGC | 212 | 1478 | 1496 |
| AD-1024086 | UGUGCUGAGCACAAUGGUG | 78 | CACCAUUGUGCUCAGCACA | 213 | 1493 | 1511 |
| AD-1024110 | UCUCUAGACACAUACGGAA | 79 | UUCCGUAUGUGUCUAGAGA | 214 | 1517 | 1535 |
| AD-1024123 | ACGGAAGUGAUGGCCUCAG | 80 | CUGAGGCCAUCACUUCCGU | 215 | 1530 | 1548 |
| AD-1024138 | UCAGUAGAAGAGACGCAAG | 81 | CUUGCGUCUCUUCUACUGA | 216 | 1545 | 1563 |
| AD-1024150 | ACGCAAGAGAAGUGGCUAU | 82 | AUAGCCACUUCUCUUGCGU | 217 | 1557 | 1575 |
| AD-1024162 | UGGCUAUUGAAGUGUCUUU | 83 | AAAGACACUUCAAUAGCCA | 218 | 1569 | 1587 |
| AD-1024174 | UGUCUUUGGAUAGCUGUCU | 84 | AGACAGCUAUCCAAAGACA | 219 | 1581 | 1599 |
| AD-1024186 | GCUGUCUGAGUGACCACGG | 85 | CCGUGGUCACUCAGACAGC | 220 | 1593 | 1611 |
| AD-1024203 | GGACAAAGUCUUAACAAAA | 86 | UUUUGUUAAGACUUUGUCC | 221 | 1610 | 1628 |
| AD-1024215 | AACAAAACUCAGGAGGACC | 87 | GGUCCUCCUGAGUUUUGUU | 222 | 1622 | 1640 |
| AD-1024230 | GACCAAUGUUAUGUCAACA | 88 | UGUUGACAUAACAUUGGUC | 223 | 1637 | 1655 |
| AD-1024243 | UCAACAGAACGCAUUUUUA | 89 | UAAAAAUGCGUUCUGUUGA | 224 | 1650 | 1668 |
| AD-1024257 | UUUUAAUCUGGUACUCACA | 90 | UGUGAGUACCAGAUUAAAA | 225 | 1664 | 1682 |
| AD-1024270 | CUCACAUAAUCAGACCAUA | 91 | UAUGGUCUGAUUAUGUGAG | 226 | 1677 | 1695 |
| AD-1024282 | GACCAUAUAGACGAGGCAC | 92 | GUGCCUCGUCUAUAUGGUC | 227 | 1689 | 1707 |
| AD-1024297 | GCACUUUGGAACCACAAGC | 93 | GCUUGUGGUUCCAAAGUGC | 228 | 1704 | 1722 |
| AD-1024309 | CACAAGCUUGGCUCACAAA | 94 | UUUGUGAGCCAAGCUUGUG | 229 | 1716 | 1734 |
| AD-1024321 | UCACAAAAGAGCUUUCUG | 95 | CAGAAAGCUCUUUUUGUGA | 230 | 1728 | 1746 |
| AD-1024333 | CUUUCUGGGUUGUAGGCCC | 96 | GGGCCUACAACCCAGAAAG | 231 | 1740 | 1758 |
| AD-1024351 | CAGACUAGACUUGCAGCAU | 97 | AUGCUGCAAGUCUAGUCUG | 232 | 1758 | 1776 |
| AD-1024371 | CAUGCUCUGUGUUCACUAG | 98 | CUAGUGAACACAGAGCAUG | 233 | 1778 | 1796 |
| AD-1024374 | GGGUUGGCUGUUUGGGAUU | 99 | AAUCCCAAACAGCCAACCC | 234 | 1797 | 1815 |
| AD-1024386 | UGGGAUUUAGUUAAACGU | 100 | ACGUUUAACUAAAAUCCCA | 235 | 1809 | 1827 |
| AD-1024401 | ACGUGUCUGUGAAUUUUUA | 101 | UAAAAAUUCACAGACACGU | 236 | 1824 | 1842 |
| AD-1024417 | GUAACUAACUCCUUUCCAU | 102 | AUGGAAAGGAGUUAGUUAC | 237 | 1844 | 1862 |
| AD-1024427 | GGUGUCUCAUGCUGCUCUU | 103 | AAGAGCAGCAUGAGACACC | 238 | 1870 | 1888 |
| AD-1024439 | UGCUCUUUGACUGUUUCAG | 104 | CUGAAACAGUCAAAGAGCA | 239 | 1882 | 1900 |
| AD-1024458 | CUUGAACAUGCAUUUUCUA | 105 | UAGAAAAUGCAUGUUCAAG | 240 | 1901 | 1919 |

TABLE 2-continued

Unmodified Sense and Antisense Strand Sequences of Solute Carrier Family 30 Member 10 (SLC30A10) dsRNA Agents

| Duplex ID | Sense Sequence 5' to 3' | SEQ ID NO: | Antisense Sequence 5'-3' | SEQ ID NO: | Target mRNA Start Position in NM_018713.2 | Target mRNA End Position in NM_018713.2 |
|---|---|---|---|---|---|---|
| AD-1024474 | CUAAAGCAAACUGCACUAG | 106 | CUAGUGCAGUUUGCUUUAG | 241 | 1917 | 1935 |
| AD-1024486 | GCACUAGUGUAUAUAUCAG | 107 | CUGAUAUAUACACUAGUGC | 242 | 1929 | 1947 |
| AD-1024501 | UCAGGGACAUUAAAGUCUG | 108 | CAGACUUUAAUGUCCCUGA | 243 | 1944 | 1962 |
| AD-1024512 | GCUCAAUAGCUGCGGAUAC | 109 | GUAUCCGCAGCUAUUGAGC | 244 | 1971 | 1989 |
| AD-1024524 | CGGAUACAGUGUUCAAAGA | 110 | UCUUUGAACACUGUAUCCG | 245 | 1983 | 2001 |
| AD-1024544 | GUUCUUGUUUCUAAACUGA | 111 | UCAGUUUAGAAACAAGAAC | 246 | 2003 | 2021 |
| AD-1024556 | AAACUGAUUAGAACUUCUA | 112 | UAGAAGUUCUAAUCAGUUU | 247 | 2015 | 2033 |
| AD-1024568 | ACUUCUAGCUAAUGCUCAG | 113 | CUGAGCAUUAGCUAGAAGU | 248 | 2027 | 2045 |
| AD-1024591 | GAUCAUAGCUUAAAUACAU | 114 | AUGUAUUUAAGCUAUGAUC | 249 | 2050 | 2068 |
| AD-1024599 | AAAAACUAAAGUACCACAA | 115 | UUGUGGUACUUUAGUUUUU | 250 | 2072 | 2090 |
| AD-1024611 | ACCACAAUAGCUGUAUUUU | 116 | AAAAUACAGCUAUUGUGGU | 251 | 2084 | 2102 |
| AD-1024622 | CCCUUAACGAUCAUAAAAG | 117 | CUUUUAUGAUCGUUAAGGG | 252 | 2111 | 2129 |
| AD-1024642 | GGCAAGUUAAGUAUUUCUG | 118 | CAGAAAUACUUAACUUGCC | 253 | 2131 | 2149 |
| AD-1024661 | GCACUGAAGAAAUAUCUUU | 119 | AAAGAUAUUUCUUCAGUGC | 254 | 2150 | 2168 |
| AD-1024666 | CUUUGAUUCAUUUUUGAAU | 120 | AUUCAAAAAUGAAUCAAAG | 255 | 2172 | 2190 |
| AD-1024670 | GAAUAACUAUUAAGGUAGA | 121 | UCUACCUUAAUAGUUAUUC | 256 | 2202 | 2220 |
| AD-1024680 | AGGUAGAAAAUAUUCUCAG | 122 | CUGAGAAUAUUUUCUACCU | 257 | 2214 | 2232 |
| AD-1024692 | UUCUCAGAACAUUCUAGAG | 123 | CUCUAGAAUGUUCUGAGAA | 258 | 2226 | 2244 |
| AD-1024711 | GAGGUAAAGGUUAGUAGGA | 124 | UCCUACUAACCUUUACCUC | 259 | 2245 | 2263 |
| AD-1024739 | CCAUCUCUACAUUUUGUGA | 125 | UCACAAAAUGUAGAGAUGG | 260 | 2273 | 2291 |
| AD-1024757 | AGGUGAGAGAAAACUAAUG | 126 | CAUUAGUUUUCUCUCACCU | 261 | 2291 | 2309 |
| AD-1024772 | AUGUUUACUUUCUGCUGUG | 127 | CACAGCAGAAAGUAAACAU | 262 | 2307 | 2325 |
| AD-1024785 | GCUGUGAACUGAACUGCAG | 128 | CUGCAGUUCAGUUCACAGC | 263 | 2320 | 2338 |
| AD-1024801 | CAGCUAUAGAAUGUUUCAA | 129 | UUGAAACAUUCUAUAGCUG | 264 | 2336 | 2354 |
| AD-1024813 | GUUUCAAAUGCUUAAAUAU | 130 | AUAUUUAAGCAUUUGAAAC | 265 | 2348 | 2366 |
| AD-1024815 | UUUUCCAUGGAAGUGAGGG | 131 | CCCUCACUUCCAUGGAAAA | 266 | 2378 | 2396 |
| AD-1024830 | AGGGAAUAUUUCAGUUUCC | 132 | GGAAACUGAAAUAUUCCCU | 267 | 2393 | 2411 |
| AD-1024844 | UUUCCUGAAGUAUGACACA | 133 | UGUGUCAUACUUCAGGAAA | 268 | 2407 | 2425 |
| AD-1024866 | ACUCAUAUACUGUCUUUUA | 134 | UAAAAGACAGUAUAUGAGU | 269 | 2429 | 2447 |
| AD-1024883 | UAGAGUCAGUAUAGUUGGA | 135 | UCCAACUAUACUGACUCUA | 270 | 2446 | 2464 |
| AD-1024902 | GCUGUUUCAUUUAGUGCU | 136 | AGCACUAAAUGAAACAGC | 271 | 2465 | 2483 |
| AD-1024916 | GUGCUUUGAUAAUGAUUUA | 137 | UAAAUCAUUAUCAAAGCAC | 272 | 2479 | 2497 |
| AD-1024921 | GAUUUACUUAUUUUUCCAA | 138 | UUGGAAAAAUAAGUAAAUC | 273 | 2492 | 2510 |
| AD-1024930 | UCCAAAUUUCGUUUGAAUU | 139 | AAUUCAAACGAAAUUUGGA | 274 | 2506 | 2524 |
| AD-1024946 | CUUUCAUAUGAUUGCAUUG | 140 | CAAUGCAAUCAUAUGAAAG | 275 | 2527 | 2545 |
| AD-1024958 | UGCAUUGAUCUAUGCAGCA | 141 | UGCUGCAUAGAUCAAUGCA | 276 | 2539 | 2557 |

TABLE 2-continued

Unmodified Sense and Antisense Strand Sequences of Solute Carrier Family 30 Member 10 (SLC30A10) dsRNA Agents

| Duplex ID | Sense Sequence 5' to 3' | SEQ ID NO: | Antisense Sequence 5'-3' | SEQ ID NO: | Target mRNA Start Position in NM_018713.2 | Target mRNA End Position in NM_018713.2 |
|---|---|---|---|---|---|---|
| AD-1024971 | GCAGCAUUUACCAGAAAAG | 142 | CUUUUCUGGUAAAUGCUGC | 277 | 2552 | 2570 |
| AD-1024987 | AAGAGUAUUCCUGGGAUAG | 143 | CUAUCCCAGGAAUACUCUU | 278 | 2568 | 2586 |
| AD-1025004 | AGCAGAAUGCAUAACACUG | 144 | CAGUGUUAUGCAUUCUGCU | 279 | 2585 | 2603 |
| AD-1025017 | ACACUGAGUGUUAAUUCUU | 145 | AAGAAUUAACACUCAGUGU | 280 | 2598 | 2616 |
| AD-1025036 | AUAAAUAAGCUAGACUGCC | 146 | GGCAGUCUAGCUUAUUUAU | 281 | 2622 | 2640 |
| AD-1025049 | ACUGCCUUCUCUUUAAUUA | 147 | UAAUUAAAGAGAAGGCAGU | 282 | 2635 | 2653 |
| AD-1025058 | GUAUUUAUUAUAGUUGUCA | 148 | UGACAACUAUAAUAAAUAC | 283 | 2667 | 2685 |
| AD-1025070 | UGUCAACUAGUAACUCAAU | 149 | AUUGAGUUACUAGUUGACA | 284 | 2681 | 2699 |
| AD-1025082 | ACUCAAUGAAAAGUUGAU | 150 | AUCAACUUUUCAUUGAGU | 285 | 2693 | 2711 |
| AD-1025103 | CCAAGGAGAAAUGAGAAU | 151 | AUUCUCAUUUCUCCCUUGG | 286 | 2714 | 2732 |
| AD-1025115 | UGAGAAUUAGCUUAAUUGC | 152 | GCAAUUAAGCUAAUUCUCA | 287 | 2726 | 2744 |
| AD-1025133 | CUGCCUUUAAUGUGUUUUU | 153 | AAAAACACAUUAAAGGCAG | 288 | 2744 | 2762 |
| AD-1025152 | GAGGAACUUAAAAUUUUCU | 154 | AGAAAAUUUUAAGUUCCUC | 289 | 2763 | 2781 |
| AD-1025158 | AUUUUCUUUCAUGUCGCUG | 155 | CAGCGACAUGAAAGAAAAU | 290 | 2775 | 2793 |
| AD-1025173 | GCUGAUCCAUAUUACCAAG | 156 | CUUGGUAAUAUGGAUCAGC | 291 | 2790 | 2808 |
| AD-1025187 | CCAAGUUCAAAUAAAAUUU | 157 | AAAUUUUAUUUGAACUUGG | 292 | 2804 | 2822 |
| AD-1025191 | UUUAUAAUCGGAUUCAGAC | 158 | GUCUGAAUCCGAUUAUAAA | 293 | 2822 | 2840 |
| AD-1025209 | CCCAUAACCAAACUAAAAA | 159 | UUUUUAGUUUGGUUAUGGG | 294 | 2840 | 2858 |

TABLE 3

Modified Sense and Antisense Strand Sequences of Solute Carrier Family 30 Member 10 (SLC30A10) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1023162 | CCACUCCUUUAGACUCUGGdTdT | 295 | CCAGAGUCUAAAGGAGUGGdTdT | 430 | CCACTCCTTTAGACTCTGG | 565 |
| AD-1023184 | CGCGUUAUAAAAAGCGGUGdTdT | 296 | CACCGCUUUUUAUAACGCGdTdT | 431 | CGCGTTATAAAAAGCGGTG | 566 |
| AD-1023195 | GGCGAGACAAUCUGGGAGGdTdT | 297 | CCUCCCAGAUUGUCUCGCCdTdT | 432 | GGCGAGACAATCTGGGAGG | 567 |
| AD-1023230 | GCUACUCUGGCAAGACGUGdTdT | 298 | CACGUCUUGCCAGAGUAGCdTdT | 433 | GCTACTCTGGCAAGACGTG | 568 |
| AD-1023255 | GCUCUUCAUGCUGGUGCUCdTdT | 299 | GAGCACCAGCAUGAAGAGCdTdT | 434 | GCTCTTCATGCTGGTGCTC | 569 |
| AD-1023273 | CACCGUCGCCUUCUUCGUGdTdT | 300 | CACGAAGAAGGCGACGGUGdTdT | 435 | CACCGTCGCCTTCTTCGTG | 570 |
| AD-1023313 | GGGCAACUCCAUCGCGCUGdTdT | 301 | CAGCGCGAUGGAGUUGCCCdTdT | 436 | GGGCAACTCCATCGCGCTG | 571 |
| AD-1023339 | ACUCCUUCAACAUGCUCUCdTdT | 302 | GAGAGCAUGUUGAAGGAGUdTdT | 437 | ACTCCTTCAACATGCTCTC | 572 |
| AD-1023357 | CCGACCUGAUCUCGCUGUGdTdT | 303 | CACAGCGAGAUCAGGUCGGdTdT | 438 | CCGACCTGATCTCGCTGTG | 573 |
| AD-1023407 | CAACGCGGUCUUCCUCACCdTdT | 304 | GGUGAGGAAGACCGCGUUGdTdT | 439 | CAACGCGGTCTTCCTCACC | 574 |
| AD-1023429 | CUCUGCUUCACCAUCUUCGdTdT | 305 | CGAAGAUGGUGAAGCAGAGdTdT | 440 | CTCTGCTTCACCATCTTCG | 575 |
| AD-1023459 | GGUGCUCAUCGUCGGCGUCdTdT | 306 | GACGCCGACGAUGAGCACCdTdT | 441 | GGTGCTCATCGTCGGCGTC | 576 |

TABLE 3-continued

Modified Sense and Antisense Strand Sequences of Solute Carrier Family 30 Member 10 (SLC30A10) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1023467 | GCUGUUGGUCAACGUGGUGdTdT | 307 | CACCACGUUGACCAACAGCdTdT | 442 | GCTGTTGGTCAACGTGGTG | 577 |
| AD-1023474 | UGCUCAUCUUCCAGGACUGdTdT | 308 | CAGUCCUGGAAGAUGAGCAdTdT | 443 | TGCTCATCTTCCAGGACTG | 578 |
| AD-1023488 | CCGCCUGGUUCGCGUGCUGdTdT | 309 | CAGCACGCGAACCAGGCGGdTdT | 444 | CCGCCTGGTTCGCGTGCTG | 579 |
| AD-1023526 | ACCUCGGUGGAAAGGAAGCdTdT | 310 | GCUUCCUUUCCACCGAGGUdTdT | 445 | ACCTCGGTGGAAAGGAAGC | 580 |
| AD-1023539 | ACCGUGUUCGCAAACGUAGdTdT | 311 | CUACGUUUGCGAACACGGUdTdT | 446 | ACCGTGTTCGCAAACGTAG | 581 |
| AD-1023559 | AGGUGAUUCCUUCAACACCdTdT | 312 | GGUGUUGAAGGAAUCACCUdTdT | 447 | AGGTGATTCCTTCAACACC | 582 |
| AD-1023575 | ACCCAGAAUGAGCCAGAAGdTdT | 313 | CUUCUGGCUCAUUCUGGGUdTdT | 448 | ACCCAGAATGAGCCAGAAG | 583 |
| AD-1023588 | CAGAAGACAUGAUGAAAAAdTdT | 314 | UUUUUCAUCAUGUCUUCUGdTdT | 449 | CAGAAGACATGATGAAAAA | 584 |
| AD-1023600 | AAGUCUGAAGCUCUGAAUAdTdT | 315 | UAUUCAGAGCUUCAGACUUdTdT | 450 | AAGTCTGAAGCTCTGAATA | 585 |
| AD-1023612 | CUGAAUAUCAGAGGUGUACdTdT | 316 | GUACACCUCUGAUAUUCAGdTdT | 451 | CTGAATATCAGAGGTGTAC | 586 |
| AD-1023624 | GGUGUACUUUUGCAUGUGAdTdT | 317 | UCACAUGCAAAAGUACACCdTdT | 452 | GGTGTACTTTTGCATGTGA | 587 |
| AD-1023646 | CGUGGUUGUGGUCAUCACGdTdT | 318 | CGUGAUGACCACAACCACGdTdT | 453 | CGTGGTTGTGGTCATCACG | 588 |
| AD-1023669 | UCAUAUUCUAUGUGCUUCCdTdT | 319 | GGAAGCACAUAGAAUAUGAdTdT | 454 | TCATATTCTATGTGCTTCC | 589 |
| AD-1023671 | CCCUGAAGAGUGAGGACCCdTdT | 320 | GGGUCCUCACUCUUCAGGGdTdT | 455 | CCCTGAAGAGTGAGGACCC | 590 |
| AD-1023684 | GGACCCGUGUAACUGGCAGdTdT | 321 | CUGCCAGUUACACGGGUCCdTdT | 456 | GGACCCGTGTAACTGGCAG | 591 |
| AD-1023696 | CUGGCAGUGUUACAUUGACdTdT | 322 | GUCAAUGUAACACUGCCAGdTdT | 457 | CTGGCAGTGTTACATTGAC | 592 |
| AD-1023707 | GACUGUCCUCAUGGUCAUCdTdT | 323 | GAUGACCAUGAGGACAGUCdTdT | 458 | GACTGTCCTCATGGTCATC | 593 |
| AD-1023719 | GGUCAUCAUCAUUUUGUCAdTdT | 324 | UGACAAAAUGAUGAUGACCdTdT | 459 | GGTCATCATCATTTTGTCA | 594 |
| AD-1023732 | UUGUCAUCUGCCUUCCCGCdTdT | 325 | GCGGGAAGGCAGAUGACAAdTdT | 460 | TTGTCATCTGCCTTCCCGC | 595 |
| AD-1023745 | UCCCGCUUAUCAAGGAGACdTdT | 326 | GUCUCCUUGAUAAGCGGGAdTdT | 461 | TCCCGCTTATCAAGGAGAC | 596 |
| AD-1023767 | UGCCAUUCUGCUACAGAUGdTdT | 327 | CAUCUGUAGCAGAAUGGCAdTdT | 462 | TGCCATTCTGCTACAGATG | 597 |
| AD-1023787 | UCCCAAAAGGAGUCAACAUdTdT | 328 | AUGUUGACUCCUUUUGGGAdTdT | 463 | TCCCAAAAGGAGTCAACAT | 598 |
| AD-1023800 | CAACAUGGAAGAGCUGAUGdTdT | 329 | CAUCAGCUCUUCCAUGUUGdTdT | 464 | CAACATGGAAGAGCTGATG | 599 |
| AD-1023812 | GCUGAUGAGUAAACUCUCUdTdT | 330 | AGAGAGUUUACUCAUCAGCdTdT | 465 | GCTGATGAGTAAACTCTCT | 600 |
| AD-1023837 | CCUGGAAUUAGCAGUGUACdTdT | 331 | GUACACUGCUAAUUCCAGGdTdT | 466 | CCTGGAATTAGCAGTGTAC | 601 |
| AD-1023849 | AGUGUACAUGAAGUGCACAdTdT | 332 | UGUGCACUUCAUGUACACUdTdT | 467 | AGTGTACATGAAGTGCACA | 602 |
| AD-1023863 | GCACAUCUGGGAACUUGUAdTdT | 333 | UACAAGUUCCCAGAUGUGCdTdT | 468 | GCACATCTGGGAACTTGTA | 603 |
| AD-1023876 | CUUGUAAGUGGAAAGAUUAdTdT | 334 | UAAUCUUUCCACUUACAAGdTdT | 469 | CTTGTAAGTGGAAAGATTA | 604 |
| AD-1023888 | AAGAUUAUUGCCACCCUGCdTdT | 335 | GCAGGGUGGCAAUAAUCUUdTdT | 470 | AAGATTATTGCCACCCTGC | 605 |
| AD-1023910 | UCAAGUAUCCUAAGGACAGdTdT | 336 | CUGUCCUUAGGAUACUUGAdTdT | 471 | TCAAGTATCCTAAGGACAG | 606 |
| AD-1023913 | GGGAUAUCAAGAUGCCAGCdTdT | 337 | GCUGGCAUCUUGAUAUCCCdTdT | 472 | GGGATATCAAGATGCCAGC | 607 |
| AD-1023930 | GCACAAAAUUCGAGAAAUdTdT | 338 | AUUUCUCGAAUUUUGUGCdTdT | 473 | GCACAAAATTCGAGAAAT | 608 |
| AD-1023942 | GAGAAAUCUUCCACCAUGCdTdT | 339 | GCAUGGUGGAAGAUUUCUCdTdT | 474 | GAGAAATCTTCCACCATGC | 609 |
| AD-1023964 | AAUCCACAAUGUGACCAUCdTdT | 340 | GAUGGUCACAUUGUGGAUUdTdT | 475 | AATCCACAATGTGACCATC | 610 |
| AD-1023979 | CAUCCAGUUUGAAAAUGUGdTdT | 341 | CACAUUUUCAAACUGGAUGdTdT | 476 | CATCCAGTTTGAAAATGTG | 611 |
| AD-1023993 | AUGUGGACUUGAAGGAACCdTdT | 342 | GGUUCCUUCAAGUCCACAUdTdT | 477 | ATGTGGACTTGAAGGAACC | 612 |
| AD-1024002 | GCAGAAGGACUUACUGUUGdTdT | 343 | CAACAGUAAGUCCUUCUGCdTdT | 478 | GCAGAAGGACTTACTGTTG | 613 |

TABLE 3-continued

Modified Sense and Antisense Strand Sequences of Solute Carrier Family 30 Member 10 (SLC30A10) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1024016 | UGUUGCUCUGCAACUCACCdTdT | 344 | GGUGAGUUGCAGAGCAACAdTdT | 479 | TGTTGCTCTGCAACTCACC | 614 |
| AD-1024030 | UCACCCUGCAUCUCCAAGGdTdT | 345 | CCUUGGAGAUGCAGGGUGAdTdT | 480 | TCACCCTGCATCTCCAAGG | 615 |
| AD-1024052 | GUGCUAAGCAGCUGUGUUGdTdT | 346 | CAACACAGCUGCUUAGCACdTdT | 481 | GTGCTAAGCAGCTGTGTTG | 616 |
| AD-1024071 | GCUCACGUCAAUGGCUGUGdTdT | 347 | CACAGCCAUUGACGUGAGCdTdT | 482 | GCTCACGTCAATGGCTGTG | 617 |
| AD-1024086 | UGUGCUGAGCACAAUGGUGdTdT | 348 | CACCAUUGUGCUCAGCACAdTdT | 483 | TGTGCTGAGCACAATGGTG | 618 |
| AD-1024110 | UCUCUAGACACAUACGGAAdTdT | 349 | UUCCGUAUGUGUCUAGAGAdTdT | 484 | TCTCTAGACACATACGGAA | 619 |
| AD-1024123 | ACGGAAGUGAUGGCCUCAGdTdT | 350 | CUGAGGCCAUCACUUCCGUdTdT | 485 | ACGGAAGTGATGGCCTCAG | 620 |
| AD-1024138 | UCAGUAGAAGAGACGCAAGdTdT | 351 | CUUGCGUCUCUUCUACUGAdTdT | 486 | TCAGTAGAAGAGACGCAAG | 621 |
| AD-1024150 | ACGCAAGAGAAGUGGCUAUdTdT | 352 | AUAGCCACUUCUCUUGCGUdTdT | 487 | ACGCAAGAGAAGTGGCTAT | 622 |
| AD-1024162 | UGGCUAUUGAAGUGUCUUUdTdT | 353 | AAAGACACUUCAAUAGCCAdTdT | 488 | TGGCTATTGAAGTGTCTTT | 623 |
| AD-1024174 | UGUCUUUGGAUAGCUGUCUdTdT | 354 | AGACAGCUAUCCAAAGACAdTdT | 489 | TGTCTTTGGATAGCTGTCT | 624 |
| AD-1024186 | GCUGUCUGAGUGACCACGGdTdT | 355 | CCGUGGUCACUCAGACAGCdTdT | 490 | GCTGTCTGAGTGACCACGG | 625 |
| AD-1024203 | GGACAAAGUCUUAACAAAAdTdT | 356 | UUUUGUUAAGACUUUGUCCdTdT | 491 | GGACAAAGTCTTAACAAAA | 626 |
| AD-1024215 | AACAAAACUCAGGAGGACCdTdT | 357 | GGUCCUCCUGAGUUUUGUUdTdT | 492 | AACAAAACTCAGGAGGACC | 627 |
| AD-1024230 | GACCAAUGUUAUGUCAACAdTdT | 358 | UGUUGACAUAACAUUGGUCdTdT | 493 | GACCAATGTTATGTCAACA | 628 |
| AD-1024243 | UCAACAGAACGCAUUUUUAdTdT | 359 | UAAAAAUGCGUUCUGUUGAdTdT | 494 | TCAACAGAACGCATTTTTA | 629 |
| AD-1024257 | UUUUAAUCUGGUACUCACAdTdT | 360 | UGUGAGUACCAGAUUAAAAdTdT | 495 | TTTTAATCTGGTACTCACA | 630 |
| AD-1024270 | CUCACAUAAUCAGACCAUAdTdT | 361 | UAUGGUCUGAUUAUGUGAGdTdT | 496 | CTCACATAATCAGACCATA | 631 |
| AD-1024282 | GACCAUAUAGACGAGGCACdTdT | 362 | GUGCCUCGUCUAUAUGGUCdTdT | 497 | GACCATATAGACGAGGCAC | 632 |
| AD-1024297 | GCACUUUGGAACCACAAGCdTdT | 363 | GCUUGUGGUUCCAAAGUGCdTdT | 498 | GCACTTTGGAACCACAAGC | 633 |
| AD-1024309 | CACAAGCUUGGCUCACAAAdTdT | 364 | UUUGUGAGCCAAGCUUGUGdTdT | 499 | CACAAGCTTGGCTCACAAA | 634 |
| AD-1024321 | UCACAAAAGAGCUUUCUGdTdT | 365 | CAGAAAGCUCUUUUGUGAdTdT | 500 | TCACAAAAGAGCTTTCTG | 635 |
| AD-1024333 | CUUUCUGGGUUGUAGGCCCdTdT | 366 | GGGCCUACAACCCAGAAAGdTdT | 501 | CTTTCTGGGTTGTAGGCCC | 636 |
| AD-1024351 | CAGACUAGACUUGCAGCAUdTdT | 367 | AUGCUGCAAGUCUAGUCUGdTdT | 502 | CAGACTAGACTTGCAGCAT | 637 |
| AD-1024371 | CAUGCUCUGUGUUCACUAGdTdT | 368 | CUAGUGAACACAGAGCAUGdTdT | 503 | CATGCTCTGTGTTCACTAG | 638 |
| AD-1024374 | GGGUUGGCUGUUUGGGAUUdTdT | 369 | AAUCCCAAACAGCCAACCCdTdT | 504 | GGGTTGGCTGTTTGGGATT | 639 |
| AD-1024386 | UGGGAUUUAGUUAAACGUdTdT | 370 | ACGUUUAACUAAAAUCCCAdTdT | 505 | TGGGATTTAGTTAAACGT | 640 |
| AD-1024401 | ACGUGUCUGUGAAUUUUUAdTdT | 371 | UAAAAAUUCACAGACACGUdTdT | 506 | ACGTGTCTGTGAATTTTTA | 641 |
| AD-1024417 | GUAACUAACUCCUUUCCAUdTdT | 372 | AUGGAAAGGAGUUAGUUACdTdT | 507 | GTAACTAACTCCTTTCCAT | 642 |
| AD-1024427 | GGUGUCUCAUGCUGCUCUUdTdT | 373 | AAGAGCAGCAUGAGACACCdTdT | 508 | GGTGTCTCATGCTGCTCTT | 643 |
| AD-1024439 | UGCUCUUUGACUGUUUCAGdTdT | 374 | CUGAAACAGUCAAAGAGCAdTdT | 509 | TGCTCTTTGACTGTTTCAG | 644 |
| AD-1024458 | CUUGAACAUGCAUUUUCUAdTdT | 375 | UAGAAAAUGCAUGUUCAAGdTdT | 510 | CTTGAACATGCATTTTCTA | 645 |
| AD-1024474 | CUAAAGCAAACUGCACUAGdTdT | 376 | CUAGUGCAGUUUGCUUUAGdTdT | 511 | CTAAAGCAAACTGCACTAG | 646 |
| AD-1024486 | GCACUAGUGUAUAUCAGdTdT | 377 | CUGAUAUAUACACUAGUGCdTdT | 512 | GCACTAGTGTATATATCAG | 647 |
| AD-1024501 | UCAGGGACAUUAAAGUCUGdTdT | 378 | CAGACUUUAAUGUCCCUGAdTdT | 513 | TCAGGGACATTAAAGTCTG | 648 |
| AD-1024512 | GCUCAAUAGCUGCGGAUACdTdT | 379 | GUAUCCGCAGCUAUUGAGCdTdT | 514 | GCTCAATAGCTGCGGATAC | 649 |

TABLE 3-continued

Modified Sense and Antisense Strand Sequences of Solute Carrier Family 30 Member 10 (SLC30A10) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1024524 | CGGAUACAGUGUUCAAAGAdTdT | 380 | UCUUUGAACACUGUAUCCGdTdT | 515 | CGGATACAGTGTTCAAAGA | 650 |
| AD-1024544 | GUUCUUGUUUCUAAACUGAdTdT | 381 | UCAGUUUAGAAACAAGAACdTdT | 516 | GTTCTTGTTTCTAAACTGA | 651 |
| AD-1024556 | AAACUGAUUAGAACUUCUAdTdT | 382 | UAGAAGUUCUAAUCAGUUUdTdT | 517 | AAACTGATTAGAACTTCTA | 652 |
| AD-1024568 | ACUUCUAGCUAAUGCUCAGdTdT | 383 | CUGAGCAUUAGCUAGAAGUdTdT | 518 | ACTTCTAGCTAATGCTCAG | 653 |
| AD-1024591 | GAUCAUAGCUUAAAUACAUdTdT | 384 | AUGUAUUUAAGCUAUGAUCdTdT | 519 | GATCATAGCTTAAATACAT | 654 |
| AD-1024599 | AAAAACUAAAGUACCACAAdTdT | 385 | UUGUGGUACUUUAGUUUUUdTdT | 520 | AAAAACTAAAGTACCACAA | 655 |
| AD-1024611 | ACCACAAUAGCUGUAUUUUdTdT | 386 | AAAAUACAGCUAUUGUGGUdTdT | 521 | ACCACAATAGCTGTATTTT | 656 |
| AD-1024622 | CCCUUAACGAUCAUAAAAGdTdT | 387 | CUUUUAUGAUCGUUAAGGGdTdT | 522 | CCCTTAACGATCATAAAAG | 657 |
| AD-1024642 | GGCAAGUUAAGUAUUUCUGdTdT | 388 | CAGAAAUACUUAACUUGCCdTdT | 523 | GGCAAGTTAAGTATTTCTG | 658 |
| AD-1024661 | GCACUGAAGAAAUAUCUUUdTdT | 389 | AAAGAUAUUUCUUCAGUGCdTdT | 524 | GCACTGAAGAAATATCTTT | 659 |
| AD-1024666 | CUUUGAUUCAUUUUGAAUdTdT | 390 | AUUCAAAAAUGAAUCAAAGdTdT | 525 | CTTTGATTCATTTTGAAT | 660 |
| AD-1024670 | GAAUAACUAUUAAGGUAGAdTdT | 391 | UCUACCUUAAUAGUUAUUCdTdT | 526 | GAATAACTATTAAGGTAGA | 661 |
| AD-1024680 | AGGUAGAAAAUAUUCUCAGdTdT | 392 | CUGAGAAUAUUUUCUACCUdTdT | 527 | AGGTAGAAAATATTCTCAG | 662 |
| AD-1024692 | UUCUCAGAACAUUCUAGAGdTdT | 393 | CUCUAGAAUGUUCUGAGAAdTdT | 528 | TTCTCAGAACATTCTAGAG | 663 |
| AD-1024711 | GAGGUAAAGGUUAGUAGGAdTdT | 394 | UCCUACUAACCUUUACCUCdTdT | 529 | GAGGTAAAGGTTAGTAGGA | 664 |
| AD-1024739 | CCAUCUCUACAUUUUGUGAdTdT | 395 | UCACAAAAUGUAGAGAUGGdTdT | 530 | CCATCTCTACATTTTGTGA | 665 |
| AD-1024757 | AGGUGAGAGAAAACUAAUGdTdT | 396 | CAUUAGUUUUCUCUCACCUdTdT | 531 | AGGTGAGAGAAAACTAATG | 666 |
| AD-1024772 | AUGUUUACUUUCUGCUGUGdTdT | 397 | CACAGCAGAAAGUAAACAUdTdT | 532 | ATGTTTACTTTCTGCTGTG | 667 |
| AD-1024785 | GCUGUGAACUGAACUGCAGdTdT | 398 | CUGCAGUUCAGUUCACAGCdTdT | 533 | GCTGTGAACTGAACTGCAG | 668 |
| AD-1024801 | CAGCUAUAGAAUGUUUCAAdTdT | 399 | UUGAAACAUUCUAUAGCUGdTdT | 534 | CAGCTATAGAATGTTTCAA | 669 |
| AD-1024813 | GUUUCAAAUGCUUAAAUAUdTdT | 400 | AUAUUUAAGCAUUUGAAACdTdT | 535 | GTTTCAAATGCTTAAATAT | 670 |
| AD-1024815 | UUUUCCAUGGAAGUGAGGGdTdT | 401 | CCCUCACUUCCAUGGAAAAdTdT | 536 | TTTTCCATGGAAGTGAGGG | 671 |
| AD-1024830 | AGGGAAUAUUUCAGUUUCCdTdT | 402 | GGAAACUGAAAUAUUCCCUdTdT | 537 | AGGGAATATTTCAGTTTCC | 672 |
| AD-1024844 | UUUCCUGAAGUAUGACACAdTdT | 403 | UGUGUCAUACUUCAGGAAAdTdT | 538 | TTTCCTGAAGTATGACACA | 673 |
| AD-1024866 | ACUCAUAUACUGUCUUUUAdTdT | 404 | UAAAAGACAGUAUAUGAGUdTdT | 539 | ACTCATATACTGTCTTTTA | 674 |
| AD-1024883 | UAGAGUCAGUAUAGUUGGAdTdT | 405 | UCCAACUAUACUGACUCUAdTdT | 540 | TAGAGTCAGTATAGTTGGA | 675 |
| AD-1024902 | GCUGUUUUCAUUUAGUGCUdTdT | 406 | AGCACUAAAUGAAAACAGCdTdT | 541 | GCTGTTTTCATTTAGTGCT | 676 |
| AD-1024916 | GUGCUUUGAUAAUGAUUUAdTdT | 407 | UAAAUCAUUAUCAAAGCACdTdT | 542 | GTGCTTTGATAATGATTTA | 677 |
| AD-1024921 | GAUUUACUUAUUUUUCCAAdTdT | 408 | UUGGAAAAAUAAGUAAAUCdTdT | 543 | GATTTACTTATTTTTCCAA | 678 |
| AD-1024930 | UCCAAAUUUCGUUUGAAUUdTdT | 409 | AAUUCAAACGAAAUUUGGAdTdT | 544 | TCCAAATTTCGTTTGAATT | 679 |
| AD-1024946 | CUUUCAUAUGAUUGCAUUGdTdT | 410 | CAAUGCAAUCAUAUGAAAGdTdT | 545 | CTTTCATATGATTGCATTG | 680 |
| AD-1024958 | UGCAUUGAUCUAUGCAGCUdTdT | 411 | UGCUGCAUAGAUCAAUGCAdTdT | 546 | TGCATTGATCTATGCAGCA | 681 |
| AD-1024971 | GCAGCAUUUACCAGAAAAGdTdT | 412 | CUUUUCGGUAAAUGCUGCdTdT | 547 | GCAGCATTTACCAGAAAAG | 682 |
| AD-1024987 | AAGAGUAUUCCUGGGAUAGdTdT | 413 | CUAUCCCAGGAAUACUCUUdTdT | 548 | AAGAGTATTCCTGGGATAG | 683 |
| AD-1025004 | AGCAGAAUGCAUAACACUGdTdT | 414 | CAGUGUUAUGCAUUCUGCUdTdT | 549 | AGCAGAATGCATAACACTG | 684 |
| AD-1025017 | ACACUGAGUGUUAAUUCUUdTdT | 415 | AAGAAUUAACACUCAGUGUdTdT | 550 | ACACTGAGTGTTAATTCTT | 685 |
| AD-1025036 | AUAAAUAAGCUAGACUGCCdTdT | 416 | GGCAGUCUAGCUUAUUUAUdTdT | 551 | ATAAATAAGCTAGACTGCC | 686 |

TABLE 3-continued

Modified Sense and Antisense Strand Sequences of Solute Carrier Family 30 Member 10 (SLC30A10) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
| --- | --- | --- | --- | --- | --- | --- |
| AD-1025049 | ACUGCCUUCUCUUUAAUUAdTdT | 417 | UAAUUAAAGAGAAGGCAGUdTdT | 552 | ACTGCCTTCTCTTTAATTA | 687 |
| AD-1025058 | GUAUUUAUUAUAGUUGUCAdTdT | 418 | UGACAACUAUAAUAAAUACdTdT | 553 | GTATTTATTATAGTTGTCA | 688 |
| AD-1025070 | UGUCAACUAGUAACUCAAUdTdT | 419 | AUUGAGUUACUAGUUGACAdTdT | 554 | TGTCAACTAGTAACTCAAT | 689 |
| AD-1025082 | ACUCAAUGAAAAGUUGAUdTdT | 420 | AUCAACUUUUCAUUGAGUdTdT | 555 | ACTCAATGAAAAGTTGAT | 690 |
| AD-1025103 | CCAAGGGAGAAAUGAGAAUdTdT | 421 | AUUCUCAUUUCUCCCUUGGdTdT | 556 | CCAAGGGAGAAATGAGAAT | 691 |
| AD-1025115 | UGAGAAUUAGCUUAAUUGCdTdT | 422 | GCAAUUAAGCUAAUUCUCAdTdT | 557 | TGAGAATTAGCTTAATTGC | 692 |
| AD-1025133 | CUGCCUUUAAUGUGUUUUUdTdT | 423 | AAAAACACAUUAAAGGCAGdTdT | 558 | CTGCCTTTAATGTGTTTTT | 693 |
| AD-1025152 | GAGGAACUUAAAAUUUUCUdTdT | 424 | AGAAAAUUUUAAGUUCCUCdTdT | 559 | GAGGAACTTAAAATTTTCT | 694 |
| AD-1025158 | AUUUUCUUUCAUGUCGCUGdTdT | 425 | CAGCGACAUGAAAGAAAAUdTdT | 560 | ATTTTCTTTCATGTCGCTG | 695 |
| AD-1025173 | GCUGAUCCAUAUUACCAAGdTdT | 426 | CUUGGUAAUAUGGAUCAGCdTdT | 561 | GCTGATCCATATTACCAAG | 696 |
| AD-1025187 | CCAAGUUCAAAUAAAAUUUdTdT | 427 | AAAUUUUAUUUGAACUUGGdTdT | 562 | CCAAGTTCAAATAAAATTT | 697 |
| AD-1025191 | UUUAUAAUCGGAUUCAGACdTdT | 428 | GUCUGAAUCCGAUUAUAAAdTdT | 563 | TTTATAATCGGATTCAGAC | 698 |
| AD-1025209 | CCCAUAACCAAACUAAAAAdTdT | 429 | UUUUUAGUUUGGUUAUGGGdTdT | 564 | CCCATAACCAAACTAAAAA | 699 |

TABLE 4

Unmodified Sense and Antisense Strand Sequences of Solute carrier family 39 member 8 dsRNA Agents

| Duplex ID | Sense Sequence 5' to 3' | Target Region in NM_001135146.2 | SEQ ID NO: | Antisense Sequence 5' to 3' | Target Region in NM_001135146.2 | SEQ ID NO: |
| --- | --- | --- | --- | --- | --- | --- |
| AD-1020688 | CCUGUCAGAGAUACAGAGG | NM_001135146.2_16-34_G19U_s | 700 | CCUCUGUAUCUCUGACAGG | NM_001135146.2_16-34_C1A_as | 835 |
| AD-1020701 | CAGAAAGAGAGAGAGAUCC | NM_001135146.2_51-69_C19U_s | 701 | GGAUCUCUCUCUCUUUCUG | NM_001135146.2_51-69_G1A_as | 836 |
| AD-1020726 | CGAGUCUUACGUUGACACG | NM_001135146.2_76-94_G19U_s | 702 | CGUGUCAACGUAAGACUCG | NM_001135146.2_76-94_C1A_as | 837 |
| AD-1020742 | ACGCAGAGAGAAAGACGCA | NM_001135146.2_92-110_A19U_s | 703 | UGCGUCUUUCUCUCUGCGU | NM_001135146.2_92-110_U1A_as | 838 |
| AD-1020758 | GCAGAGACAGACAAACAAA | NM_001135146.2_108-126_A19U_s | 704 | UUUGUUUGUCUGUCUCUGC | NM_001135146.2_108-126_U1A_as | 839 |
| AD-1020769 | AAACAGAUAGGAGAGGCUC | NM_001135146.2_124-142_C19U_s | 705 | GAGCCUCUCCUAUCUGUUU | NM_001135146.2_124-142_G1A_as | 840 |
| AD-1020796 | CUACGCUGCCACUUCAAUG | NM_001135146.2_186-204_G19U_s | 706 | CAUUGAAGUGGCAGCGUAG | NM_001135146.2_186-204_C1A_as | 841 |
| AD-1020811 | AGCUGCUGUUCUUUCGAAG | NM_001135146.2_219-237_G19U_s | 707 | CUUCGAAAGAACAGCAGCU | NM_001135146.2_219-237_C1A_as | 842 |
| AD-1020908 | GGGCUAGCCUUCAGCGAGG | NM_001135146.2_467-485_G19U_s | 708 | CCUCGCUGAAGGCUAGCCC | NM_001135146.2_467-485_C1A_as | 843 |
| AD-1020925 | GGAUGUGCUGAGCGUGUUC | NM_001135146.2_484-502_C19U_s | 709 | GAACACGCUCAGCACAUCC | NM_001135146.2_484-502_G1A_as | 844 |
| AD-1020963 | CCAGCACUUGCUGGAGCAG | NM_001135146.2_535-553_G19U_s | 710 | CUGCUCCAGCAAGUGCUGG | NM_001135146.2_535-553_C1A_as | 845 |
| AD-1020999 | CUUCAACCAGUGUUUAACU | NM_001135146.2_601-619_s | 711 | AGUUAAACACUGGUUGAAG | NM_001135146.2_601-619_as | 846 |

TABLE 4-continued

Unmodified Sense and Antisense Strand Sequences of Solute carrier family 39 member 8 dsRNA Agents

| Duplex ID | Sense Sequence 5' to 3' | Target Region in NM_001135146.2 | SEQ ID NO: | Antisense Sequence 5' to 3' | Target Region in NM_001135146.2 | SEQ ID NO: |
|---|---|---|---|---|---|---|
| AD-1021025 | AGAUCUUUUCCCUUCAUGG | NM_001135146.2_627-645_G19U_s | 712 | CCAUGAAGGGAAAAGAUCU | NM_001135146.2_627-645_C1A_as | 847 |
| AD-1021041 | UGGCUUUUCAAAUGCUACC | NM_001135146.2_643-661_C19U_s | 713 | GGUAGCAUUUGAAAAGCCA | NM_001135146.2_643-661_G1A_as | 848 |
| AD-1021058 | CCCAAAUAACCAGCUCCAA | NM_001135146.2_660-678_A19U_s | 714 | UUGGAGCUGGUUAUUUGGG | NM_001135146.2_660-678_U1A_as | 849 |
| AD-1021073 | CCAAAUUCUCUGUCAUCUG | NM_001135146.2_675-693_G19U_s | 715 | CAGAUGACAGAGAAUUUGG | NM_001135146.2_675-693_C1A_as | 850 |
| AD-1021098 | AGUCUUACAGCAAUUGAAC | NM_001135146.2_700-718_C19U_s | 716 | GUUCAAUUGCUGUAAGACU | NM_001135146.2_700-718_G1A_as | 851 |
| AD-1021113 | GAACUUUCACCCAUGUGAG | NM_001135146.2_715-733_G19U_s | 717 | CUCACAUGGGUGAAAGUUC | NM_001135146.2_715-733_C1A_as | 852 |
| AD-1021136 | GGCCCAAGCACAAAACAAG | NM_001135146.2_738-756_G19U_s | 718 | CUUGUUUUGUGCUUGGGCC | NM_001135146.2_738-756_C1A_as | 853 |
| AD-1021151 | AGACCAAGUCAUUCAGAAG | NM_001135146.2_755-773_G19U_s | 719 | CUUCUGAAUGACUUGGUCU | NM_001135146.2_755-773_C1A_as | 854 |
| AD-1021169 | UCCUGUCAGUGACGAUUAU | NM_001135146.2_789-807_s | 720 | AUAAUCGUCACUGACAGGA | NM_001135146.2_789-807_as | 855 |
| AD-1021185 | UAUUAAUCUGGCAUCUCUC | NM_001135146.2_805-823_C19U_s | 721 | GAGAGAUGCCAGAUUAAUA | NM_001135146.2_805-823_G1A_as | 856 |
| AD-1021205 | UCGGAUUGAUUUUGACUCC | NM_001135146.2_825-843_C19U_s | 722 | GGAGUCAAAAUCAAUCCGA | NM_001135146.2_825-843_G1A_as | 857 |
| AD-1021222 | CCACUGAUAAAGAAAUCUU | NM_001135146.2_842-860_s | 723 | AAGAUUUCUUUAUCAGUGG | NM_001135146.2_842-860_as | 858 |
| AD-1021241 | UCCCAAAGAUUUUGACCUU | NM_001135146.2_864-882_s | 724 | AAGGUCAAAAUCUUUGGGA | NM_001135146.2_864-882_as | 859 |
| AD-1021250 | GGCUAUUGGGACUCUUUUU | NM_001135146.2_895-913_s | 725 | AAAAAGAGUCCCAAUAGCC | NM_001135146.2_895-913_as | 860 |
| AD-1021260 | GCAAUUUUCCAACUUAUUC | NM_001135146.2_920-938_C19U_s | 726 | GAAUAAGUUGGAAAAUUGC | NM_001135146.2_920-938_G1A_as | 861 |
| AD-1021282 | AGGCAUUUGGAUUUGAUCC | NM_001135146.2_942-960_C19U_s | 727 | GGAUCAAAUCCAAAUGCCU | NM_001135146.2_942-960_G1A_as | 862 |
| AD-1021297 | AUCCCAAAGUCGACAGUUA | NM_001135146.2_957-975_A19U_s | 728 | UAACUGUCGACUUUGGGAU | NM_001135146.2_957-975_U1A_as | 863 |
| AD-1021326 | GCAGUUGCUGUGUUUGGUG | NM_001135146.2_986-1004_G19U_s | 729 | CACCAAACACAGCAACUGC | NM_001135146.2_986-1004_C1A_as | 864 |
| AD-1021342 | GUGGAUUUUACCUACUUUU | NM_001135146.2_1002-1020_s | 730 | AAAAGUAGGUAAAAUCCAC | NM_001135146.2_1002-1020_as | 865 |
| AD-1021358 | UGCUAAAGAUGUUAUUAAA | NM_001135146.2_1035-1053_A19U_s | 731 | UUUAAUAACAUCUUUAGCA | NM_001135146.2_1035-1053_U1A_as | 866 |
| AD-1021382 | GGUCAGAAUGGUCAUACCC | NM_001135146.2_1061-1079_C19U_s | 732 | GGGUAUGACCAUUCUGACC | NM_001135146.2_1061-1079_G1A_as | 867 |
| AD-1021399 | CCACUUUGGAAAUGAUAAC | NM_001135146.2_1078-1096_C19U_s | 733 | GUUAUCAUUUCCAAAGUGG | NM_001135146.2_1078-1096_G1A_as | 868 |
| AD-1021417 | CUUUGGUCCUCAAGAAAAA | NM_001135146.2_1096-1114_A19U_s | 734 | UUUUUCUUGAGGACCAAAG | NM_001135146.2_1096-1114_U1A_as | 869 |

TABLE 4-continued

Unmodified Sense and Antisense Strand Sequences of Solute carrier family 39 member 8 dsRNA Agents

| Duplex ID | Sense Sequence 5' to 3' | Target Region in NM_001135146.2 | SEQ ID NO: | Antisense Sequence 5' to 3' | Target Region in NM_001135146.2 | SEQ ID NO: |
|---|---|---|---|---|---|---|
| AD-1021423 | CUCAUCAACCUAAAGCAUU | NM_001135146.2_1116-1134_s | 735 | AAUGCUUUAGGUUGAUGAG | NM_001135146.2_1116-1134_as | 870 |
| AD-1021447 | CCAUCAAUGGUGUGACAUG | NM_001135146.2_1140-1158_G19U_s | 736 | CAUGUCACACCAUUGAUGG | NM_001135146.2_1140-1158_C1A_as | 871 |
| AD-1021462 | CAUGCUAUGCAAAUCCUGC | NM_001135146.2_1155-1173_C19U_s | 737 | GCAGGAUUUGCAUAGCAUG | NM_001135146.2_1155-1173_G1A_as | 872 |
| AD-1021479 | GCUGUCACAGAAGCUAAUG | NM_001135146.2_1172-1190_G19U_s | 738 | CAUUAGCUUCUGUGACAGC | NM_001135146.2_1172-1190_C1A_as | 873 |
| AD-1021497 | GGACAUAUCCAUUUGAUA | NM_001135146.2_1190-1208_A19U_s | 739 | UAUCAAAUGGAUAUGUCC | NM_001135146.2_1190-1208_U1A_as | 874 |
| AD-1021515 | AAUGUCAGUGUGGUAUCUC | NM_001135146.2_1208-1226_C19U_s | 740 | GAGAUACCACACUGACAUU | NM_001135146.2_1208-1226_G1A_as | 875 |
| AD-1021530 | UCUCUACAGGAUGGAAAAA | NM_001135146.2_1223-1241_A19U_s | 741 | UUUUUCCAUCCUGUAGAGA | NM_001135146.2_1223-1241_U1A_as | 876 |
| AD-1021540 | CAAGUUCAUGUACCUGUUU | NM_001135146.2_1248-1266_s | 742 | AAACAGGUACAUGAACUUG | NM_001135146.2_1248-1266_as | 877 |
| AD-1021549 | GCCCAAACUGUCAGAAAUA | NM_001135146.2_1273-1291_A19U_s | 743 | UAUUUCUGACAGUUUGGGC | NM_001135146.2_1273-1291_U1A_as | 878 |
| AD-1021578 | CCUGGAUGAUAACGCUCUG | NM_001135146.2_1302-1320_G19U_s | 744 | CAGAGCGUUAUCAUCCAGG | NM_001135146.2_1302-1320_C1A_as | 879 |
| AD-1021604 | CUCCACAAUUUCAUCGAUG | NM_001135146.2_1328-1346_G19U_s | 745 | CAUCGAUGAAAUUGUGGAG | NM_001135146.2_1328-1346_C1A_as | 880 |
| AD-1021629 | CACCUUGUCUCUCCUUCAG | NM_001135146.2_1369-1387_G19U_s | 746 | CUGAAGGAGAGACAAGGUG | NM_001135146.2_1369-1387_C1A_as | 881 |
| AD-1021649 | GACUCAGUACUUCCAUAGC | NM_001135146.2_1389-1407_C19U_s | 747 | GCUAUGGAAGUACUGAGUC | NM_001135146.2_1389-1407_G1A_as | 882 |
| AD-1021670 | UCCUAUGUGAGGAGUUUCC | NM_001135146.2_1410-1428_C19U_s | 748 | GGAAACUCCUCACAUAGGA | NM_001135146.2_1410-1428_G1A_as | 883 |
| AD-1021673 | CCACGAGUUAGGAGACUUU | NM_001135146.2_1429-1447_s | 749 | AAAGUCUCCUAACUCGUGG | NM_001135146.2_1429-1447_as | 884 |
| AD-1021688 | CUUUGUGAUCCUACUCAAU | NM_001135146.2_1444-1462_s | 750 | AUUGAGUAGGAUCACAAAG | NM_001135146.2_1444-1462_as | 885 |
| AD-1021711 | GGAUGAGCACUCGACAAGC | NM_001135146.2_1467-1485_C19U_s | 751 | GCUUGUCGAGUGCUCAUCC | NM_001135146.2_1467-1485_G1A_as | 886 |
| AD-1021727 | AGCCUUGCUAUUCAACUUC | NM_001135146.2_1483-1501_C19U_s | 752 | GAAGUUGAAUAGCAAGGCU | NM_001135146.2_1483-1501_G1A_as | 887 |
| AD-1021742 | CUUCCUUUCUGCAUGUUCC | NM_001135146.2_1498-1516_C19U_s | 753 | GGAACAUGCAGAAAGGAAG | NM_001135146.2_1498-1516_G1A_as | 888 |
| AD-1021757 | UUCCUGCUAUGUUGGGCUA | NM_001135146.2_1513-1531_A19U_s | 754 | UAGCCCAACAUAGCAGGAA | NM_001135146.2_1513-1531_U1A_as | 889 |
| AD-1021772 | GCUAGCUUUUGGCAUUUG | NM_001135146.2_1528-1546_G19U_s | 755 | CAAAAUGCCAAAAGCUAGC | NM_001135146.2_1528-1546_C1A_as | 890 |
| AD-1021796 | CAACAAUUUCGCUCCAAAU | NM_001135146.2_1552-1570_s | 756 | AUUUGGAGCGAAAUUGUUG | NM_001135146.2_1552-1570_as | 891 |
| AD-1021814 | UUAUAUUUGCACUUGCUGG | NM_001135146.2_1572-1590_G19U_s | 757 | CCAGCAAGUGCAAAUAUAA | NM_001135146.2_1572-1590_C1A_as | 892 |
| AD-1021836 | CAUGUUCCUCUAUAUUUCU | NM_001135146.2_1594-1612_s | 758 | AGAAAUAUAGAGGAACAUG | NM_001135146.2_1594-1612_as | 893 |
| AD-1021853 | CUCUGGCAGAUAUGUUUCC | NM_001135146.2_1611-1629_C19U_s | 759 | GGAAACAUAUCUGCCAGAG | NM_001135146.2_1611-1629_G1A_as | 894 |

TABLE 4-continued

Unmodified Sense and Antisense Strand Sequences of Solute carrier family 39 member 8 dsRNA Agents

| Duplex ID | Sense Sequence 5' to 3' | Target Region in NM_001135146.2 | SEQ ID NO: | Antisense Sequence 5' to 3' | Target Region in NM_001135146.2 | SEQ ID NO: |
|---|---|---|---|---|---|---|
| AD-1021869 | UCCAGAGAUGAAUGAUAUG | NM_001135146.2_1627-1645_G19U_s | 760 | CAUAUCAUUCAUCUCUGGA | NM_001135146.2_1627-1645_C1A_as | 895 |
| AD-1021884 | UAUGCUGAGAGAAAAGGUA | NM_001135146.2_1642-1660_A19U_s | 761 | UACCUUUUCUCUCAGCAUA | NM_001135146.2_1642-1660_U1A_as | 896 |
| AD-1021900 | GUAACUGGAAGAAAAACCG | NM_001135146.2_1658-1676_G19U_s | 762 | CGGUUUUUCUUCCAGUUAC | NM_001135146.2_1658-1676_C1A_as | 897 |
| AD-1021915 | ACCGAUUUCACCUUCUUCA | NM_001135146.2_1673-1691_A19U_s | 763 | UGAAGAAGGUGAAAUCGGU | NM_001135146.2_1673-1691_U1A_as | 898 |
| AD-1021942 | AAUGCUGGAAUGUUAACUG | NM_001135146.2_1700-1718_G19U_s | 764 | CAGUUAACAUUCCAGCAUU | NM_001135146.2_1700-1718_C1A_as | 899 |
| AD-1021971 | CAUUCUACUCAUUACCUUG | NM_001135146.2_1729-1747_G19U_s | 765 | CAAGGUAAUGAGUAGAAUG | NM_001135146.2_1729-1747_C1A_as | 900 |
| AD-1021986 | CUUGUAUGCAGGAGAAAUC | NM_001135146.2_1744-1762_C19U_s | 766 | GAUUUCUCCUGCAUACAAG | NM_001135146.2_1744-1762_G1A_as | 901 |
| AD-1022007 | AUUGGAGUAAUAGAAAAUG | NM_001135146.2_1765-1783_G19U_s | 767 | CAUUUUCUAUUACUCCAAU | NM_001135146.2_1765-1783_C1A_as | 902 |
| AD-1022030 | AUGGUGUUGUUAAUAAAGG | NM_001135146.2_1788-1806_G19U_s | 768 | CCUUUAUUAACAACACCAU | NM_001135146.2_1788-1806_C1A_as | 903 |
| AD-1022044 | AGGCAUUUAAUAGAUAAAA | NM_001135146.2_1804-1822_A19U_s | 769 | UUUUAUCUAUUAAAUGCCU | NM_001135146.2_1804-1822_U1A_as | 904 |
| AD-1022056 | CAUCUCCAAAAAGGAUUUU | NM_001135146.2_1824-1842_s | 770 | AAAAUCCUUUUUGGAGAUG | NM_001135146.2_1824-1842_as | 905 |
| AD-1022079 | CUGAUCCUAUUUAGUUAAA | NM_001135146.2_1847-1865_A19U_s | 771 | UUUAACUAAAUAGGAUCAG | NM_001135146.2_1847-1865_U1A_as | 906 |
| AD-1022095 | UGCUUUCAACUGUAGGUCC | NM_001135146.2_1876-1894_C19U_s | 772 | GGACCUACAGUUGAAAGCA | NM_001135146.2_1876-1894_G1A_as | 907 |
| AD-1022110 | GUCCAGAAAACUAAUUAUU | NM_001135146.2_1891-1909_s | 773 | AAUAAUUAGUUUUCUGGAC | NM_001135146.2_1891-1909_as | 908 |
| AD-1022133 | UCAGUCUGUGAAAUAGUCC | NM_001135146.2_1914-1932_C19U_s | 774 | GGACUAUUUCACAGACUGA | NM_001135146.2_1914-1932_G1A_as | 909 |
| AD-1022148 | GUCCAUUAUUUGUUGUUAA | NM_001135146.2_1929-1947_A19U_s | 775 | UUAACAACAAAUAAUGGAC | NM_001135146.2_1929-1947_U1A_as | 910 |
| AD-1022159 | UUAAAAAUGCUUCAAAAGG | NM_001135146.2_1944-1962_G19U_s | 776 | CCUUUUGAAGCAUUUUUAA | NM_001135146.2_1944-1962_C1A_as | 911 |
| AD-1022176 | GGUUUUCAGUGUCAGUCUG | NM_001135146.2_1961-1979_G19U_s | 777 | CAGACUGACACUGAAAACC | NM_001135146.2_1961-1979_C1A_as | 912 |
| AD-1022202 | UGGUAUAUAGGAGCCUUUG | NM_001135146.2_1987-2005_G19U_s | 778 | CAAAGGCUCCUAUAUACCA | NM_001135146.2_1987-2005_C1A_as | 913 |
| AD-1022220 | GGGAAAUACCUAUUUUUCA | NM_001135146.2_2005-2023_A19U_s | 779 | UGAAAAAUAGGUAUUUCCC | NM_001135146.2_2005-2023_U1A_as | 914 |
| AD-1022236 | UCAGUAUUCCAUGCAUAUU | NM_001135146.2_2021-2039_s | 780 | AAUAUGCAUGGAAUACUGA | NM_001135146.2_2021-2039_as | 915 |
| AD-1022261 | CACCAUGAAGCAAGAGACA | NM_001135146.2_2046-2064_A19U_s | 781 | UGUCUCUUGCUUCAUGGUG | NM_001135146.2_2046-2064_U1A_as | 916 |
| AD-1022276 | GACAUGCAUUCUAUAAUCA | NM_001135146.2_2061-2079_A19U_s | 782 | UGAUUAUAGAAUGCAUGUC | NM_001135146.2_2061-2079_U1A_as | 917 |

TABLE 4-continued

Unmodified Sense and Antisense Strand Sequences of Solute carrier family 39 member 8 dsRNA Agents

| Duplex ID | Sense Sequence 5' to 3' | Target Region in NM_001135146.2 | SEQ ID NO: | Antisense Sequence 5' to 3' | Target Region in NM_001135146.2 | SEQ ID NO: |
|---|---|---|---|---|---|---|
| AD-1022295 | UGUAGACACUCAGACUCAG | NM_001135146.2_2080-2098_G19U_s | 783 | CUGAGUCUGAGUGUCUACA | NM_001135146.2_2080-2098_C1A_as | 918 |
| AD-1022298 | GGGAAAAUACAAGUUAUAU | NM_001135146.2_2099-2117_s | 784 | AUAUAACUUGUAUUUUCCC | NM_001135146.2_2099-2117_as | 919 |
| AD-1022318 | CUGAAAGCCUUUAAAACUC | NM_001135146.2_2119-2137_C19U_s | 785 | GAGUUUUAAAGGCUUUCAG | NM_001135146.2_2119-2137_G1A_as | 920 |
| AD-1022339 | UGGUAGGAUCAAAGAUUCA | NM_001135146.2_2140-2158_A19U_s | 786 | UGAAUCUUUGAUCCUACCA | NM_001135146.2_2140-2158_U1A_as | 921 |
| AD-1022354 | UUCAAAUGGUUUCAGAGAG | NM_001135146.2_2155-2173_G19U_s | 787 | CUCUCUGAAACCAUUUGAA | NM_001135146.2_2155-2173_C1A_as | 922 |
| AD-1022370 | GAGGUUUUAUUUCAAUUAA | NM_001135146.2_2171-2189_A19U_s | 788 | UUAAUUGAAAUAAAACCUC | NM_001135146.2_2171-2189_U1A_as | 923 |
| AD-1022381 | UGUUCUAGUGCUUUCAAGA | NM_001135146.2_2192-2210_A19U_s | 789 | UCUUGAAAGCACUAGAACA | NM_001135146.2_2192-2210_U1A_as | 924 |
| AD-1022398 | GAGCAAGUACAUCAAAAUG | NM_001135146.2_2209-2227_G19U_s | 790 | CAUUUUGAUGUACUUGCUC | NM_001135146.2_2209-2227_C1A_as | 925 |
| AD-1022415 | GUAGAAGGUAAAAUGUAUG | NM_001135146.2_2227-2245_G19U_s | 791 | CAUACAUUUUACCUUCUAC | NM_001135146.2_2227-2245_C1A_as | 926 |
| AD-1022433 | GCAACACUAAUAUAAAUUA | NM_001135146.2_2245-2263_A19U_s | 792 | UAAUUUAUAUUAGUGUUGC | NM_001135146.2_2245-2263_U1A_as | 927 |
| AD-1022442 | AUUCCAAGUCUUUAAGGAG | NM_001135146.2_2263-2281_G19U_s | 793 | CUCCUUAAAGACUUGGAAU | NM_001135146.2_2263-2281_C1A_as | 928 |
| AD-1022462 | UUCUCACAGCUUUUUGUUC | NM_001135146.2_2299-2317_C19U_s | 794 | GAACAAAAAGCUGUGAGAA | NM_001135146.2_2299-2317_G1A_as | 929 |
| AD-1022473 | UCUGUUUUGUAUUUCAAUU | NM_001135146.2_2316-2334_s | 795 | AAUUGAAAUACAAAACAGA | NM_001135146.2_2316-2334_as | 930 |
| AD-1022493 | GAACUUGCAGUAUUAUUUU | NM_001135146.2_2337-2355_s | 796 | AAAAUAAUACUGCAAGUUC | NM_001135146.2_2337-2355_as | 931 |
| AD-1022511 | ACCAUUCUAAAAUAAUAGG | NM_001135146.2_2360-2378_G19U_s | 797 | CCUAUUAUUUUAGAAUGGU | NM_001135146.2_2360-2378_C1A_as | 932 |
| AD-1022528 | GGAGUUAGGAAAUAAAUAA | NM_001135146.2_2377-2395_A19U_s | 798 | UUAUUUAUUUCCUAACUCC | NM_001135146.2_2377-2395_U1A_as | 933 |
| AD-1022535 | UAAAGUUUUGCUAGCCCUG | NM_001135146.2_2393-2411_G19U_s | 799 | CAGGGCUAGCAAAACUUUA | NM_001135146.2_2393-2411_C1A_as | 934 |
| AD-1022551 | CUGCUAAGUUCAGGCUUAG | NM_001135146.2_2409-2427_G19U_s | 800 | CUAAGCCUGAACUUAGCAG | NM_001135146.2_2409-2427_C1A_as | 935 |
| AD-1022578 | CGCUAAGUAUAAACUUCAC | NM_001135146.2_2436-2454_C19U_s | 801 | GUGAAGUUUAUACUUAGCG | NM_001135146.2_2436-2454_G1A_as | 936 |
| AD-1022594 | CACCAGAUUCCACGAAAAG | NM_001135146.2_2452-2470_G19U_s | 802 | CUUUUCGUGGAAUCUGGUG | NM_001135146.2_2452-2470_C1A_as | 937 |
| AD-1022614 | CUGACUUAUGUUGUGGUUG | NM_001135146.2_2487-2505_G19U_s | 803 | CAACCACAACAUAAGUCAG | NM_001135146.2_2487-2505_C1A_as | 938 |
| AD-1022622 | CUCACAAAUGGCAGAACAG | NM_001135146.2_2511-2529_G19U_s | 804 | CUGUUCUGCCAUUUGUGAG | NM_001135146.2_2511-2529_C1A_as | 939 |
| AD-1022640 | GUAUGUAAAGCUGGUAACA | NM_001135146.2_2529-2547_A19U_s | 805 | UGUUACCAGCUUUACAUAC | NM_001135146.2_2529-2547_U1A_as | 940 |
| AD-1022655 | AACACCUCGGUUUCAGUGC | NM_001135146.2_2544-2562_C19U_s | 806 | GCACUGAAACCGAGGUGUU | NM_001135146.2_2544-2562_G1A_as | 941 |
| AD-1022672 | GCACCAUGUGUUUGCUUUG | NM_001135146.2_2561-2579_G19U_s | 807 | CAAAGCAAACACAUGGUGC | NM_001135146.2_2561-2579_C1A_as | 942 |

TABLE 4-continued

Unmodified Sense and Antisense Strand Sequences of Solute carrier family 39 member 8 dsRNA Agents

| Duplex ID | Sense Sequence 5' to 3' | Target Region in NM_001135146.2 | SEQ ID NO: | Antisense Sequence 5' to 3' | Target Region in NM_001135146.2 | SEQ ID NO: |
|---|---|---|---|---|---|---|
| AD-1022692 | GAAGGUGAAGAAUAUGUUG | NM_001135146.2_2581-2599_G19U_s | 808 | CAACAUAUUCUUCACCUUC | NM_001135146.2_2581-2599_C1A_as | 943 |
| AD-1022710 | GGUUUAGAGAAAGAAAUUG | NM_001135146.2_2599-2617_G19U_s | 809 | CAAUUUCUUUCUCUAAACC | NM_001135146.2_2599-2617_C1A_as | 944 |
| AD-1022723 | AUUGGAUGUAAUUUUAUGC | NM_001135146.2_2614-2632_C19U_s | 810 | GCAUAAAAUUACAUCCAAU | NM_001135146.2_2614-2632_G1A_as | 945 |
| AD-1022728 | UGCAAUUUACUUUUAAAGA | NM_001135146.2_2630-2648_A19U_s | 811 | UCUUUAAAAGUAAAUUGCA | NM_001135146.2_2630-2648_U1A_as | 946 |
| AD-1022741 | GACAAACAUAACUAUUUAG | NM_001135146.2_2647-2665_G19U_s | 812 | CUAAAUAGUUAUGUUUGUC | NM_001135146.2_2647-2665_C1A_as | 947 |
| AD-1022759 | GCAGAGAAUAUUUUAAUAA | NM_001135146.2_2665-2683_A19U_s | 813 | UUAUUAAAAUAUUCUCUGC | NM_001135146.2_2665-2683_U1A_as | 948 |
| AD-1022767 | UGCAAACAACAGCUGGAC | NM_001135146.2_2685-2703_C19U_s | 814 | GUCCAGCUGUUGUUUUGCA | NM_001135146.2_2685-2703_G1A_as | 949 |
| AD-1022784 | ACUGCUGUACAUCAAGGAC | NM_001135146.2_2702-2720_C19U_s | 815 | GUCCUUGAUGUACAGCAGU | NM_001135146.2_2702-2720_G1A_as | 950 |
| AD-1022800 | GACAGAUUAACUGGAAAAC | NM_001135146.2_2718-2736_C19U_s | 816 | GUUUUCCAGUUAAUCUGUC | NM_001135146.2_2718-2736_G1A_as | 951 |
| AD-1022823 | GUUCCUUAUGUGUGAUCGA | NM_001135146.2_2741-2759_A19U_s | 817 | UCGAUCACACAUAAGGAAC | NM_001135146.2_2741-2759_U1A_as | 952 |
| AD-1022849 | UCAGAAAAGACUUCCUUUG | NM_001135146.2_2767-2785_G19U_s | 818 | CAAAGGAAGUCUUUUCUGA | NM_001135146.2_2767-2785_C1A_as | 953 |
| AD-1022874 | GCCUAUACUUUUCCAUAUG | NM_001135146.2_2792-2810_G19U_s | 819 | CAUAUGGAAAAGUAUAGGC | NM_001135146.2_2792-2810_C1A_as | 954 |
| AD-1022889 | UAUGGUAUACCUUGAAAAA | NM_001135146.2_2807-2825_A19U_s | 820 | UUUUUCAAGGUAUACCAUA | NM_001135146.2_2807-2825_U1A_as | 955 |
| AD-1022900 | ACACCAUGGUUAUUUUUCU | NM_001135146.2_2833-2851_s | 821 | AGAAAAAUAACCAUGGUGU | NM_001135146.2_2833-2851_as | 956 |
| AD-1022911 | CUACCUUUUAUAAAAGACA | NM_001135146.2_2850-2868_A19U_s | 822 | UGUCUUUUAUAAAAGGUAG | NM_001135146.2_2850-2868_U1A_as | 957 |
| AD-1022933 | CCUGUUUACUCAUUUAGAA | NM_001135146.2_2872-2890_A19U_s | 823 | UUCUAAAUGAGUAAACAGG | NM_001135146.2_2872-2890_U1A_as | 958 |
| AD-1022949 | GAAGAUAGAGAAAAUUGGU | NM_001135146.2_2888-2906_s | 824 | ACCAAUUUUCUCUAUCUUC | NM_001135146.2_2888-2906_as | 959 |
| AD-1022965 | GGUCUAAAAUUGAACAUCC | NM_001135146.2_2904-2922_C19U_s | 825 | GGAUGUUCAAUUUUAGACC | NM_001135146.2_2904-2922_G1A_as | 960 |
| AD-1022980 | AUCCUAGAUUCACACUCCC | NM_001135146.2_2919-2937_C19U_s | 826 | GGGAGUGUGAAUCUAGGAU | NM_001135146.2_2919-2937_G1A_as | 961 |
| AD-1022995 | UCCCAAGUCACUUAAGGUG | NM_001135146.2_2934-2952_G19U_s | 827 | CACCUUAAGUGACUUGGGA | NM_001135146.2_2934-2952_C1A_as | 962 |
| AD-1023024 | GAGGAAAAUGAUUGACAAA | NM_001135146.2_2963-2981_A19U_s | 828 | UUUGUCAAUCAUUUUCCUC | NM_001135146.2_2963-2981_U1A_as | 963 |
| AD-1023040 | AAAGCCCAACAAUGAUCUC | NM_001135146.2_2979-2997_C19U_s | 829 | GAGAUCAUUGUUGGGCUUU | NM_001135146.2_2979-2997_G1A_as | 964 |
| AD-1023055 | UCUCAGGAAUUACAUUUUC | NM_001135146.2_2994-3012_C19U_s | 830 | GAAAAUGUAAUUCCUGAGA | NM_001135146.2_2994-3012_G1A_as | 965 |
| AD-1023074 | AUGUUUUCAUGUAGCAGCA | NM_001135146.2_3027-3045_A19U_s | 831 | UGCUGCUACAUGAAAACAU | NM_001135146.2_3027-3045_U1A_as | 966 |

TABLE 4-continued

Unmodified Sense and Antisense Strand Sequences of Solute carrier family 39 member 8 dsRNA Agents

| Duplex ID | Sense Sequence 5' to 3' | Target Region in NM_001135146.2 | SEQ ID NO: | Antisense Sequence 5' to 3' | Target Region in NM_001135146.2 | SEQ ID NO: |
|---|---|---|---|---|---|---|
| AD-1023094 | UGCAGAUUUGGUGAAUAUU | NM_001135146.2_3047-3065_s | 832 | AAUAUUCACCAAAUCUGCA | NM_001135146.2_3047-3065_as | 967 |
| AD-1023114 | CACUUUAUGACUGACAAUU | NM_001135146.2_3090-3108_s | 833 | AAUUGUCAGUCAUAAAGUG | NM_001135146.2_3090-3108_as | 968 |
| AD-1023133 | GGCCAAAUAGUAAACACCC | NM_001135146.2_3123-3141_C19U_s | 834 | GGGUGUUUACUAUUUGGCC | NM_001135146.2_3123-3141_G1A_as | 969 |

TABLE 5

Modified Sense and Antisense Strand Sequences of Solute carrier family 39 member 8(SLC39A8) dsRNA Agents

| Duplex ID | Sense Sequence 5'-3' | SEQ ID NO: | Antisense Sequence 5'-3' | SEQ ID NO: | mRNA Target Sequence 5'-3' | SEQ ID NO: |
|---|---|---|---|---|---|---|
| AD-1020688 | CCUGUCAGAGAUACAGAGGdTdT | 970 | CCUCUGUAUCUCUGACAGGdTdT | 1105 | CCTGTCAGAGATACAGAGG | 1240 |
| AD-1020701 | CAGAAAGAGAGAGAGAUCCdTdT | 971 | GGAUCUCUCUCUCUUUCUGdTdT | 1106 | CAGAAAGAGAGAGAGATCC | 1241 |
| AD-1020726 | CGAGUCUUACGUUGACACGdTdT | 972 | CGUGUCAACGUAAGACUCGdTdT | 1107 | CGAGTCTTACGTTGACACG | 1242 |
| AD-1020742 | ACGCAGAGAGAAAGACGCAdTdT | 973 | UGCGUCUUUCUCUCUGCGUdTdT | 1108 | ACGCAGAGAGAAAGACGCA | 1243 |
| AD-1020758 | GCAGAGACAGACAAACAAAdTdT | 974 | UUUGUUUGUCUGUCUCUGCdTdT | 1109 | GCAGAGACAGACAAACAAA | 1244 |
| AD-1020769 | AAACAGAUAGGAGAGGCUCdTdT | 975 | GAGCCUCUCCUAUCUGUUUdTdT | 1110 | AAACAGATAGGAGAGGCTC | 1245 |
| AD-1020796 | CUACGCUGCCACUUCAAUGdTdT | 976 | CAUUGAAGUGGCAGCGUAGdTdT | 1111 | CTACGCTGCCACTTCAATG | 1246 |
| AD-1020811 | AGCUGCUGUUCUUUCGAAGdTdT | 977 | CUUCGAAAGAACAGCAGCUdTdT | 1112 | AGCTGCTGTTCTTTCGAAG | 1247 |
| AD-1020908 | GGGCUAGCCUUCAGCGAGGdTdT | 978 | CCUCGCUGAAGGCUAGCCCdTdT | 1113 | GGGCTAGCCTTCAGCGAGG | 1248 |
| AD-1020925 | GGAUGUGCUGAGCGUGUUCdTdT | 979 | GAACACGCUCAGCACAUCCdTdT | 1114 | GGATGTGCTGAGCGTGTTC | 1249 |
| AD-1020963 | CCAGCACUUGCUGGAGCAGdTdT | 980 | CUGCUCCAGCAAGUGCUGGdTdT | 1115 | CCAGCACTTGCTGGAGCAG | 1250 |
| AD-1020999 | CUUCAACCAGUGUUUAACUdTdT | 981 | AGUUAAACACUGGUUGAAGdTdT | 1116 | CTTCAACCAGTGTTTAACT | 1251 |
| AD-1021025 | AGAUCUUUUCCCUUCAUGGdTdT | 982 | CCAUGAAGGGAAAAGAUCUdTdT | 1117 | AGATCTTTTCCCTTCATGG | 1252 |
| AD-1021041 | UGGCUUUUCAAAUGCUACCdTdT | 983 | GGUAGCAUUUGAAAAGCCAdTdT | 1118 | TGGCTTTTCAAATGCTACC | 1253 |
| AD-1021058 | CCCAAAUAACCAGCUCCAAdTdT | 984 | UUGGAGCUGGUUAUUUGGGdTdT | 1119 | CCCAAATAACCAGCTCCAA | 1254 |
| AD-1021073 | CCAAAUUCUCUGUCAUCUGdTdT | 985 | CAGAUGACAGAGAAUUUGGdTdT | 1120 | CCAAATTCTCTGTCATCTG | 1255 |
| AD-1021098 | AGUCUUACAGCAAUUGAACdTdT | 986 | GUUCAAUUGCUGUAAGACUdTdT | 1121 | AGTCTTACAGCAATTGAAC | 1256 |
| AD-1021113 | GAACUUUCACCCAUGUGAGdTdT | 987 | CUCACAUGGGUGAAAGUUCdTdT | 1122 | GAACTTTCACCCATGTGAG | 1257 |
| AD-1021136 | GGCCCAAGCACAAAACAAGdTdT | 988 | CUUGUUUUGUGCUUGGGCCdTdT | 1123 | GGCCCAAGCACAAAACAAG | 1258 |
| AD-1021151 | AGACCAAGUCAUUCAGAAGdTdT | 989 | CUUCUGAAUGACUUGGUCUdTdT | 1124 | AGACCAAGTCATTCAGAAG | 1259 |
| AD-1021169 | UCCUGUCAGUGACGAUUAUdTdT | 990 | AUAAUCGUCACUGACAGGAdTdT | 1125 | TCCTGTCAGTGACGATTAT | 1260 |
| AD-1021185 | UAUUAAUCUGGCAUCUCUCdTdT | 991 | GAGAGAUGCCAGAUUAAUAdTdT | 1126 | TATTAATCTGGCATCTCTC | 1261 |
| AD-1021205 | UCGGAUUGAUUUUGACUCCdTdT | 992 | GGAGUCAAAAUCAAUCCGAdTdT | 1127 | TCGGATTGATTTTGACTCC | 1262 |
| AD-1021222 | CCACUGAUAAAGAAAUCUUdTdT | 993 | AAGAUUUCUUUAUCAGUGGdTdT | 1128 | CCACTGATAAAGAAATCTT | 1263 |
| AD-1021241 | UCCCAAAGAUUUUGACCUUdTdT | 994 | AAGGUCAAAAUCUUUGGGAdTdT | 1129 | TCCCAAAGATTTTGACCTT | 1264 |
| AD-1021250 | GGCUAUGGGACUCUUUUUUdTdT | 995 | AAAAAGAGUCCCAUAGCCdTdT | 1130 | GGCTATGGGACTCTTTTTT | 1265 |
| AD-1021260 | GCAAUUUUCCAACUUAUUCdTdT | 996 | GAAUAAGUUGGAAAAUUGCdTdT | 1131 | GCAATTTTCCAACTTATTC | 1266 |

TABLE 5-continued

Modified Sense and Antisense Strand Sequences of Solute carrier family 39 member 8(SLC39A8) dsRNA Agents

| Duplex ID | Sense Sequence 5'-3' | SEQ ID NO: | Antisense Sequence 5'-3' | SEQ ID NO: | mRNA Target Sequence 5'-3' | SEQ ID NO: |
|---|---|---|---|---|---|---|
| AD-1021282 | AGGCAUUUGGAUUUGAUCCdTdT | 997 | GGAUCAAAUCCAAAUGCCUdTdT | 1132 | AGGCATTTGGATTTGATCC | 1267 |
| AD-1021297 | AUCCCAAAGUCGACAGUUAdTdT | 998 | UAACUGUCGACUUUGGGAUdTdT | 1133 | ATCCCAAAGTCGACAGTTA | 1268 |
| AD-1021326 | GCAGUUGCUGUGUUUGGUGdTdT | 999 | CACCAAACACAGCAACUGCdTdT | 1134 | GCAGTTGCTGTGTTTGGTG | 1269 |
| AD-1021342 | GUGGAUUUUACCUACUUUUdTdT | 1000 | AAAAGUAGGUAAAAUCCACdTdT | 1135 | GTGGATTTTACCTACTTTT | 1270 |
| AD-1021358 | UGCUAAAGAUGUUAUUAAAdTdT | 1001 | UUUAAUAACAUCUUUAGCAdTdT | 1136 | TGCTAAAGATGTTATTAAA | 1271 |
| AD-1021382 | GGUCAGAAUGGUCAUACCCdTdT | 1002 | GGGUAUGACCAUUCUGACCdTdT | 1137 | GGTCAGAATGGTCATACCC | 1272 |
| AD-1021399 | CCACUUUGGAAAUGAUAACdTdT | 1003 | GUUAUCAUUUCCAAAGUGGdTdT | 1138 | CCACTTTGGAAATGATAAC | 1273 |
| AD-1021417 | CUUUGGUCCUCAAGAAAAAdTdT | 1004 | UUUUUCUUGAGGACCAAAGdTdT | 1139 | CTTTGGTCCTCAAGAAAAA | 1274 |
| AD-1021423 | CUCAUCAACCUAAAGCAUUdTdT | 1005 | AAUGCUUUAGGUUGAUGAGdTdT | 1140 | CTCATCAACCTAAAGCATT | 1275 |
| AD-1021447 | CCAUCAAUGGUGUGACAUGdTdT | 1006 | CAUGUCACACCAUUGAUGGdTdT | 1141 | CCATCAATGGTGTGACATG | 1276 |
| AD-1021462 | CAUGCUAUGCAAAUCCUGCdTdT | 1007 | GCAGGAUUUGCAUAGCAUGdTdT | 1142 | CATGCTATGCAAATCCTGC | 1277 |
| AD-1021479 | GCUGUCACAGAAGCUAAUGdTdT | 1008 | CAUUAGCUUCUGUGACAGCdTdT | 1143 | GCTGTCACAGAAGCTAATG | 1278 |
| AD-1021497 | GGACAUAUCCAUUUGAUAdTdT | 1009 | UAUCAAAAUGGAUAUGUCCdTdT | 1144 | GGACATATCCATTTGATA | 1279 |
| AD-1021515 | AAUGUCAGUGUGGUAUCUCdTdT | 1010 | GAGAUACCACACUGACAUUdTdT | 1145 | AATGTCAGTGTGGTATCTC | 1280 |
| AD-1021530 | UCUCUACAGGAUGGAAAAAdTdT | 1011 | UUUUUCCAUCCUGUAGAGAdTdT | 1146 | TCTCTACAGGATGGAAAAA | 1281 |
| AD-1021540 | CAAGUUCAUGUACCUGUUUdTdT | 1012 | AAACAGGUACAUGAACUUGdTdT | 1147 | CAAGTTCATGTACCTGTTT | 1282 |
| AD-1021549 | GCCCAAACUGUCAGAAAUAdTdT | 1013 | UAUUUCUGACAGUUUGGGCdTdT | 1148 | GCCCAAACTGTCAGAAATA | 1283 |
| AD-1021578 | CCUGGAUGAUAACGCUCUGdTdT | 1014 | CAGAGCGUUAUCAUCCAGGdTdT | 1149 | CCTGGATGATAACGCTCTG | 1284 |
| AD-1021604 | CUCCACAAUUUCAUCGAUGdTdT | 1015 | CAUCGAUGAAAUUGUGGAGdTdT | 1150 | CTCCACAATTTCATCGATG | 1285 |
| AD-1021629 | CACCUUGUCUCUCCUUCAGdTdT | 1016 | CUGAAGGAGAGACAAGGUGdTdT | 1151 | CACCTTGTCTCTCCTTCAG | 1286 |
| AD-1021649 | GACUCAGUACUUCCAUAGCdTdT | 1017 | GCUAUGGAAGUACUGAGUCdTdT | 1152 | GACTCAGTACTTCCATAGC | 1287 |
| AD-1021670 | UCCUAUGUGAGGAGUUUCCdTdT | 1018 | GGAAACUCCUCACAUAGGAdTdT | 1153 | TCCTATGTGAGGAGTTTCC | 1288 |
| AD-1021673 | CCACGAGUUAGGAGACUUUdTdT | 1019 | AAAGUCUCCUAACUCGUGGdTdT | 1154 | CCACGAGTTAGGAGACTTT | 1289 |
| AD-1021688 | CUUUGUGAUCCUACUCAAUdTdT | 1020 | AUUGAGUAGGAUCACAAAGdTdT | 1155 | CTTTGTGATCCTACTCAAT | 1290 |
| AD-1021711 | GGAUGAGCACUCGACAAGCdTdT | 1021 | GCUUGUCGAGUGCUCAUCCdTdT | 1156 | GGATGAGCACTCGACAAGC | 1291 |
| AD-1021727 | AGCCUUGCUAUUCAACUUCdTdT | 1022 | GAAGUUGAAUAGCAAGGCUdTdT | 1157 | AGCCTTGCTATTCAACTTC | 1292 |
| AD-1021742 | CUUCCUUUCUGCAUGUUCCdTdT | 1023 | GGAACAUGCAGAAAGGAAGdTdT | 1158 | CTTCCTTTCTGCATGTTCC | 1293 |
| AD-1021757 | UUCCUGCUAUGUUGGGCUAdTdT | 1024 | UAGCCCAACAUAGCAGGAAdTdT | 1159 | TTCCTGCTATGTTGGGCTA | 1294 |
| AD-1021772 | GCUAGCUUUUGGCAUUUUGdTdT | 1025 | CAAAAUGCCAAAAGCUAGCdTdT | 1160 | GCTAGCTTTTGGCATTTTG | 1295 |
| AD-1021796 | CAACAAUUUCGCUCCAAAUdTdT | 1026 | AUUUGGAGCGAAAUUGUUGdTdT | 1161 | CAACAATTTCGCTCCAAAT | 1296 |
| AD-1021814 | UUAUAUUUGCACUUGCUGGdTdT | 1027 | CCAGCAAGUGCAAAUAUAAdTdT | 1162 | TTATATTTGCACTTGCTGG | 1297 |
| AD-1021836 | CAUGUUCCUCUAUAUUUCUdTdT | 1028 | AGAAAUAUAGAGGAACAUGdTdT | 1163 | CATGTTCCTCTATATTTCT | 1298 |
| AD-1021853 | CUCUGGCAGAUAUGUUUCCdTdT | 1029 | GGAAACAUAUCUGCCAGAGdTdT | 1164 | CTCTGGCAGATATGTTTCC | 1299 |
| AD-1021869 | UCCAGAGAUGAAUGAUAUGdTdT | 1030 | CAUAUCAUUCAUCUCUGGAdTdT | 1165 | TCCAGAGATGAATGATATG | 1300 |
| AD-1021884 | UAUGCUGAGAGAAAAGGUAdTdT | 1031 | UACCUUUUCUCUCAGCAUAdTdT | 1166 | TATGCTGAGAGAAAAGGTA | 1301 |
| AD-1021900 | GUAACUGGAAGAAAAACCGdTdT | 1032 | CGGUUUUUCUUCCAGUUACdTdT | 1167 | GTAACTGGAAGAAAAACCG | 1302 |

TABLE 5-continued

Modified Sense and Antisense Strand Sequences of Solute carrier family 39 member 8(SLC39A8) dsRNA Agents

| Duplex ID | Sense Sequence 5'-3' | SEQ ID NO: | Antisense Sequence 5'-3' | SEQ ID NO: | mRNA Target Sequence 5'-3' | SEQ ID NO: |
|---|---|---|---|---|---|---|
| AD-1021915 | ACCGAUUUCACCUUCUUCAdTdT | 1033 | UGAAGAAGGUGAAAUCGGUdTdT | 1168 | ACCGATTTCACCTTCTTCA | 1303 |
| AD-1021942 | AAUGCUGGAAUGUUAACUGdTdT | 1034 | CAGUUAACAUUCCAGCAUUdTdT | 1169 | AATGCTGGAATGTTAACTG | 1304 |
| AD-1021971 | CAUUCUACUCAUUACCUUGdTdT | 1035 | CAAGGUAAUGAGUAGAAUGdTdT | 1170 | CATTCTACTCATTACCTTG | 1305 |
| AD-1021986 | CUUGUAUGCAGGAGAAAUCdTdT | 1036 | GAUUUCUCCUGCAUACAAGdTdT | 1171 | CTTGTATGCAGGAGAAATC | 1306 |
| AD-1022007 | AUUGGAGUAAUAGAAAAUGdTdT | 1037 | CAUUUUCUAUUACUCCAAUdTdT | 1172 | ATTGGAGTAATAGAAAATG | 1307 |
| AD-1022030 | AUGGUGUUGUUAAUAAAGGdTdT | 1038 | CCUUUAUUAACAACACCAUdTdT | 1173 | ATGGTGTTGTTAATAAAGG | 1308 |
| AD-1022044 | AGGCAUUUAAUAGAUAAAAdTdT | 1039 | UUUUAUCUAUUAAAUGCCUdTdT | 1174 | AGGCATTTAATAGATAAAA | 1309 |
| AD-1022056 | CAUCUCCAAAAAGGAUUUUdTdT | 1040 | AAAAUCCUUUUUGGAGAUGdTdT | 1175 | CATCTCCAAAAAGGATTTT | 1310 |
| AD-1022079 | CUGAUCCUAUUUAGUUAAAdTdT | 1041 | UUUAACUAAAUAGGAUCAGdTdT | 1176 | CTGATCCTATTTAGTTAAA | 1311 |
| AD-1022095 | UGCUUUCAACUGUAGGUCCdTdT | 1042 | GGACCUACAGUUGAAAGCAdTdT | 1177 | TGCTTTCAACTGTAGGTCC | 1312 |
| AD-1022110 | GUCCAGAAAACUAAUUAUUdTdT | 1043 | AAUAAUUAGUUUUCUGGACdTdT | 1178 | GTCCAGAAAACTAATTATT | 1313 |
| AD-1022133 | UCAGUCUGUGAAAUAGUCCdTdT | 1044 | GGACUAUUUCACAGACUGAdTdT | 1179 | TCAGTCTGTGAAATAGTCC | 1314 |
| AD-1022148 | GUCCAUUAUUGUUGUUAAdTdT | 1045 | UUAACAACAAAUAAUGGACdTdT | 1180 | GTCCATTATTGTTGTTAA | 1315 |
| AD-1022159 | UUAAAAAUGCUUCAAAAGGdTdT | 1046 | CCUUUUGAAGCAUUUUUAAdTdT | 1181 | TTAAAAATGCTTCAAAAGG | 1316 |
| AD-1022176 | GGUUUUCAGUGUCAGUCUGdTdT | 1047 | CAGACUGACACUGAAAACCdTdT | 1182 | GGTTTTCAGTGTCAGTCTG | 1317 |
| AD-1022202 | UGGUAUAUAGGAGCCUUUGdTdT | 1048 | CAAAGGCUCCUAUAUACCAdTdT | 1183 | TGGTATATAGGAGCCTTTG | 1318 |
| AD-1022220 | GGGAAAUACCUAUUUUUCAdTdT | 1049 | UGAAAAAUAGGUAUUUCCCdTdT | 1184 | GGGAAATACCTATTTTTCA | 1319 |
| AD-1022236 | UCAGUAUUCCAUGCAUAUUdTdT | 1050 | AAUAUGCAUGGAAUACUGAdTdT | 1185 | TCAGTATTCCATGCATATT | 1320 |
| AD-1022261 | CACCAUGAAGCAAGAGACAdTdT | 1051 | UGUCUCUUGCUUCAUGGUGdTdT | 1186 | CACCATGAAGCAAGAGACA | 1321 |
| AD-1022276 | GACAUGCAUUCUAUAAUCAdTdT | 1052 | UGAUUAUAGAAUGCAUGUCdTdT | 1187 | GACATGCATTCTATAATCA | 1322 |
| AD-1022295 | UGUAGACACUCAGACUCAGdTdT | 1053 | CUGAGUCUGAGUGUCUACAdTdT | 1188 | TGTAGACACTCAGACTCAG | 1323 |
| AD-1022298 | GGGAAAAUACAAGUUAUAUdTdT | 1054 | AUAUAACUUGUAUUUUCCCdTdT | 1189 | GGGAAAATACAAGTTATAT | 1324 |
| AD-1022318 | CUGAAAGCCUUUAAAACUCdTdT | 1055 | GAGUUUUAAAGGCUUUCAGdTdT | 1190 | CTGAAAGCCTTTAAAACTC | 1325 |
| AD-1022339 | UGGUAGGAUCAAAGAUUCAdTdT | 1056 | UGAAUCUUUGAUCCUACCAdTdT | 1191 | TGGTAGGATCAAAGATTCA | 1326 |
| AD-1022354 | UUCAAAUGGUUUCAGAGAGdTdT | 1057 | CUCUCUGAAACCAUUUGAAdTdT | 1192 | TTCAAATGGTTTCAGAGAG | 1327 |
| AD-1022370 | GAGGUUUUAUUUCAAUUAAdTdT | 1058 | UUAAUUGAAAUAAAACCUCdTdT | 1193 | GAGGTTTTATTTCAATTAA | 1328 |
| AD-1022381 | UGUUCUAGUGCUUUCAAGAdTdT | 1059 | UCUUGAAAGCACUAGAACAdTdT | 1194 | TGTTCTAGTGCTTTCAAGA | 1329 |
| AD-1022398 | GAGCAAGUACAUCAAAAUGdTdT | 1060 | CAUUUUGAUGUACUUGCUCdTdT | 1195 | GAGCAAGTACATCAAAATG | 1330 |
| AD-1022415 | GUAGAAGGUAAAAUGUAUGdTdT | 1061 | CAUACAUUUUACCUUCUACdTdT | 1196 | GTAGAAGGTAAAATGTATG | 1331 |
| AD-1022433 | GCAACACUAAUAUAAAUUAdTdT | 1062 | UAAUUUAUAUUAGUGUUGCdTdT | 1197 | GCAACACTAATATAAATTA | 1332 |
| AD-1022442 | AUUCCAAGUCUUUAAGGAGdTdT | 1063 | CUCCUUAAAGACUUGGAAUdTdT | 1198 | ATTCCAAGTCTTTAAGGAG | 1333 |
| AD-1022462 | UUCUCACAGCUUUUUGUUCdTdT | 1064 | GAACAAAAAGCUGUGAGAAdTdT | 1199 | TTCTCACAGCTTTTTGTTC | 1334 |
| AD-1022473 | UCUGUUUUGUAUUUCAAUUdTdT | 1065 | AAUUGAAAUACAAAACAGAdTdT | 1200 | TCTGTTTTGTATTTCAATT | 1335 |
| AD-1022493 | GAACUUGCAGUAUUAUUUUdTdT | 1066 | AAAAUAAUACUGCAAGUUCdTdT | 1201 | GAACTTGCAGTATTATTTT | 1336 |
| AD-1022511 | ACCAUUCUAAAAUAAUAGGdTdT | 1067 | CCUAUUAUUUUAGAAUGGUdTdT | 1202 | ACCATTCTAAAATAATAGG | 1337 |
| AD-1022528 | GGAGUUAGGAAAUAAAUAAdTdT | 1068 | UUAUUUAUUUCCUAACUCCdTdT | 1203 | GGAGTTAGGAAATAAATAA | 1338 |
| AD-1022535 | UAAAGUUUUGCUAGCCCUGdTdT | 1069 | CAGGGCUAGCAAAACUUUAdTdT | 1204 | TAAAGTTTTGCTAGCCCTG | 1339 |

TABLE 5-continued

Modified Sense and Antisense Strand Sequences of Solute carrier family 39 member 8(SLC39A8) dsRNA Agents

| Duplex ID | Sense Sequence 5'-3' | SEQ ID NO: | Antisense Sequence 5'-3' | SEQ ID NO: | mRNA Target Sequence 5'-3' | SEQ ID NO: |
|---|---|---|---|---|---|---|
| AD-1022551 | CUGCUAAGUUCAGGCUUAGdTdT | 1070 | CUAAGCCUGAACUUAGCAGdTdT | 1205 | CTGCTAAGTTCAGGCTTAG | 1340 |
| AD-1022578 | CGCUAAGUAUAAACUUCACdTdT | 1071 | GUGAAGUUUAUACUUAGCGdTdT | 1206 | CGCTAAGTATAAACTTCAC | 1341 |
| AD-1022594 | CACCAGAUUCCACGAAAAGdTdT | 1072 | CUUUUCGUGGAAUCUGGUGdTdT | 1207 | CACCAGATTCCACGAAAAG | 1342 |
| AD-1022614 | CUGACUUAUGUUGUGGUUGdTdT | 1073 | CAACCACAACAUAAGUCAGdTdT | 1208 | CTGACTTATGTTGTGGTTG | 1343 |
| AD-1022622 | CUCACAAAUGGCAGAACAGdTdT | 1074 | CUGUUCUGCCAUUUGUGAGdTdT | 1209 | CTCACAAATGGCAGAACAG | 1344 |
| AD-1022640 | GUAUGUAAAGCUGGUAACAdTdT | 1075 | UGUUACCAGCUUUACAUACdTdT | 1210 | GTATGTAAAGCTGGTAACA | 1345 |
| AD-1022655 | AACACCUCGGUUUCAGUGCdTdT | 1076 | GCACUGAAACCGAGGUGUUdTdT | 1211 | AACACCTCGGTTTCAGTGC | 1346 |
| AD-1022672 | GCACCAUGUGUUUGCUUUGdTdT | 1077 | CAAAGCAAACACAUGGUGCdTdT | 1212 | GCACCATGTGTTTGCTTTG | 1347 |
| AD-1022692 | GAAGGUGAAGAAUAUGUUGdTdT | 1078 | CAACAUAUUCUUCACCUUCdTdT | 1213 | GAAGGTGAAGAATATGTTG | 1348 |
| AD-1022710 | GGUUUAGAGAAAGAAAUUGdTdT | 1079 | CAAUUUCUUUCUCUAAACCdTdT | 1214 | GGTTTAGAGAAAGAAATTG | 1349 |
| AD-1022723 | AUUGGAUGUAAUUUUAUGCdTdT | 1080 | GCAUAAAAUUACAUCCAAUdTdT | 1215 | ATTGGATGTAATTTTATGC | 1350 |
| AD-1022728 | UGCAAUUUACUUUUAAAGAdTdT | 1081 | UCUUUAAAAGUAAAUUGCAdTdT | 1216 | TGCAATTTACTTTTAAAGA | 1351 |
| AD-1022741 | GACAAACAUAACUAUUUAGdTdT | 1082 | CUAAAUAGUUAUGUUUGUCdTdT | 1217 | GACAAACATAACTATTTAG | 1352 |
| AD-1022759 | GCAGAGAAUAUUUUAAUAAdTdT | 1083 | UUAUUAAAAUAUUCUCUGCdTdT | 1218 | GCAGAGAATATTTTAATAA | 1353 |
| AD-1022767 | UGCAAAACAACAGCUGGACdTdT | 1084 | GUCCAGCUGUUGUUUUGCAdTdT | 1219 | TGCAAAACAACAGCTGGAC | 1354 |
| AD-1022784 | ACUGCUGUACAUCAAGGACdTdT | 1085 | GUCCUUGAUGUACAGCAGUdTdT | 1220 | ACTGCTGTACATCAAGGAC | 1355 |
| AD-1022800 | GACAGAUUAACUGGAAAACdTdT | 1086 | GUUUUCCAGUUAAUCUGUCdTdT | 1221 | GACAGATTAACTGGAAAAC | 1356 |
| AD-1022823 | GUUCCUUAUGUGUGAUCGAdTdT | 1087 | UCGAUCACACAUAAGGAACdTdT | 1222 | GTTCCTTATGTGTGATCGA | 1357 |
| AD-1022849 | UCAGAAAAGACUUCCUUUGdTdT | 1088 | CAAAGGAAGUCUUUUCUGAdTdT | 1223 | TCAGAAAAGACTTCCTTTG | 1358 |
| AD-1022874 | GCCUAUACUUUUCCAUAUGdTdT | 1089 | CAUAUGGAAAAGUAUAGGCdTdT | 1224 | GCCTATACTTTTCCATATG | 1359 |
| AD-1022889 | UAUGGUAUACCUUGAAAAAdTdT | 1090 | UUUUUCAAGGUAUACCAUAdTdT | 1225 | TATGGTATACCTTGAAAAA | 1360 |
| AD-1022900 | ACACCAUGGUUAUUUUUCUdTdT | 1091 | AGAAAAAUAACCAUGGUGUdTdT | 1226 | ACACCATGGTTATTTTTCT | 1361 |
| AD-1022911 | CUACCUUUUAUAAAAGACAdTdT | 1092 | UGUCUUUUAUAAAAGGUAGdTdT | 1227 | CTACCTTTTATAAAAGACA | 1362 |
| AD-1022933 | CCUGUUUACUCAUUUAGAAdTdT | 1093 | UUCUAAAUGAGUAAACAGGdTdT | 1228 | CCTGTTTACTCATTTAGAA | 1363 |
| AD-1022949 | GAAGAUAGAGAAAAUUGGUdTdT | 1094 | ACCAAUUUUCUCUAUCUUCdTdT | 1229 | GAAGATAGAGAAAATTGGT | 1364 |
| AD-1022965 | GGUCUAAAAUUGAACAUCCdTdT | 1095 | GGAUGUUCAAUUUUAGACCdTdT | 1230 | GGTCTAAAATTGAACATCC | 1365 |
| AD-1022980 | AUCCUAGAUUCACACUCCCdTdT | 1096 | GGGAGUGUGAAUCUAGGAUdTdT | 1231 | ATCCTAGATTCACACTCCC | 1366 |
| AD-1022995 | UCCCAAGUCACUUAAGGUGdTdT | 1097 | CACCUUAAGUGACUUGGGAdTdT | 1232 | TCCCAAGTCACTTAAGGTG | 1367 |
| AD-1023024 | GAGGAAAAUGAUUGACAAAdTdT | 1098 | UUUGUCAAUCAUUUUCCUCdTdT | 1233 | GAGGAAAATGATTGACAAA | 1368 |
| AD-1023040 | AAAGCCCAACAAUGAUCUCdTdT | 1099 | GAGAUCAUUGUUGGGCUUUdTdT | 1234 | AAAGCCCAACAATGATCTC | 1369 |
| AD-1023055 | UCUCAGGAAUUACAUUUUCdTdT | 1100 | GAAAAUGUAAUUCCUGAGAdTdT | 1235 | TCTCAGGAATTACATTTTC | 1370 |
| AD-1023074 | AUGUUUUCAUGUAGCAGCAdTdT | 1101 | UGCUGCUACAUGAAAACAUdTdT | 1236 | ATGTTTTCATGTAGCAGCA | 1371 |
| AD-1023094 | UGCAGAUUUGGUGAAUAUUdTdT | 1102 | AAUAUUCACCAAAUCUGCAdTdT | 1237 | TGCAGATTTGGTGAATATT | 1372 |
| AD-1023114 | CACUUUAUGACUGACAAUUdTdT | 1103 | AAUUGUCAGUCAUAAAGUGdTdT | 1238 | CACTTTATGACTGACAATT | 1373 |
| AD-1023133 | GGCCAAAUAGUAAACACCCdTdT | 1104 | GGGUGUUUACUAUUUGGCCdTdT | 1239 | GGCCAAATAGTAAACACCC | 1374 |

TABLE 6

Unmodified Sense and Antisense Strand Sequences of Solute carrier family 39 member 8 dsRNA Agents

| Duplex Name | Sense Sequence 5' to 3' | Target Region in NM_026228.5 | SEQ ID NO: | Antisense Sequence 5' to 3' | Target Region in NM_026228.5 | SEQ ID NO: |
|---|---|---|---|---|---|---|
| AD-858799.1 | UUUUCUCUUCAUGGUUUCUCA | 726-746 | 1375 | UGAGAAACCAUGAAGAGAAAAGA | 724-746 | 1465 |
| AD-858788.1 | CAGAAGACAUCUUUUCUCUUA | 715-735 | 1376 | UAAGAGAAAAGAUGUCUUCUGCU | 713-735 | 1466 |
| AD-859876.1 | GAAUAGGUGAAAUUUGUUGUA | 2046-2066 | 1377 | UACAACAAAUUUCACCUAUUCUA | 2044-2066 | 1467 |
| AD-858795.1 | CAUCUUUUCUCUUCAUGGUUA | 722-742 | 1378 | UAACCAUGAAGAGAAAAGAUGUC | 720-742 | 1468 |
| AD-859603.1 | UAUGUUUCCAGAGAUGAACGA | 1721-1741 | 1379 | UCGUUCAUCUCUGGAAACAUAUC | 1719-1741 | 1469 |
| AD-858793.1 | GACAUCUUUUCUCUUCAUGGA | 720-740 | 1380 | UCCAUGAAGAGAAAAGAUGUCUU | 718-740 | 1470 |
| AD-858792.1 | AGACAUCUUUUCUCUUCAUGA | 719-739 | 1381 | UCAUGAAGAGAAAAGAUGUCUUC | 717-739 | 1471 |
| AD-859877.1 | AAUAGGUGAAAUUUGUUGUUA | 2047-2067 | 1382 | UAACAACAAAUUUCACCUAUUCU | 2045-2067 | 1472 |
| AD-859893.1 | CCUUAAAAGGUUUUCGGUUUA | 2076-2096 | 1383 | UAAACCGAAAACCUUUUAAGGAA | 2074-2096 | 1473 |
| AD-859083.1 | UGUUUGGUGGAUUUUACAUGA | 1090-1110 | 1384 | UCAUGUAAAAUCCACCAAACACA | 1088-1110 | 1474 |
| AD-859006.1 | CGCCAUUUUCCAGCUUAUUCA | 1013-1033 | 1385 | UGAAUAAGCUGGAAAAUGGCGUU | 1011-1033 | 1475 |
| AD-858797.1 | UCUUUUCUCUUCAUGGUUUCA | 724-744 | 1386 | UGAAACCAUGAAGAGAAAAGAUG | 722-744 | 1476 |
| AD-858794.1 | ACAUCUUUUCUCUUCAUGGUA | 721-741 | 1387 | UACCAUGAAGAGAAAAGAUGUCU | 719-741 | 1477 |
| AD-859804.1 | CAGAAACAUCUCCAUAGGGAA | 1923-1943 | 1388 | UUCCCUAUGGAGAUGUUUCUGUG | 1921-1943 | 1478 |
| AD-859008.1 | CCAUUUUCCAGCUUAUUCCAA | 1015-1035 | 1389 | UUGGAAUAAGCUGGAAAAUGGCG | 1013-1035 | 1479 |
| AD-859080.1 | CUGUGUUUGGUGGAUUUUACA | 1087-1107 | 1390 | UGUAAAAUCCACCAAACACAGCA | 1085-1107 | 1480 |
| AD-859878.1 | AUAGGUGAAAUUUGUUGUUAA | 2048-2068 | 1391 | UUAACAACAAAUUUCACCUAUUC | 2046-2068 | 1481 |
| AD-858791.1 | AAGACAUCUUUUCUCUUCAUA | 718-738 | 1392 | UAUGAAGAGAAAAGAUGUCUUCU | 716-738 | 1482 |
| AD-859628.1 | CUGAGAGAAAAGUAACUGGA | 1746-1766 | 1393 | UCCAGUUACUUUUUCUCUCAGCA | 1744-1766 | 1483 |
| AD-859027.1 | AGAGGCAUUUGGAUUUAAUCA | 1034-1054 | 1394 | UGAUUAAAUCCAAAUGCCUCUGG | 1032-1054 | 1484 |
| AD-859849.1 | AAUCUAAUGACUGGUUUCAGA | 2019-2039 | 1395 | UCUGAAACCAGUCAUUAGAUUCC | 2017-2039 | 1485 |
| AD-859874.1 | UAGAAUAGGUGAAAUUUGUUA | 2044-2064 | 1396 | UAACAAAUUUCACCUAUUCUACA | 2042-2064 | 1486 |
| AD-859093.1 | AUUUUACAUGCUUUUCUUUGA | 1100-1120 | 1397 | UCAAAGAAAAGCAUGUAAAAUCC | 1098-1120 | 1487 |
| AD-860219.1 | CUGUAGGAUUGUUUUGAAAGA | 2493-2513 | 1398 | UCUUUCAAAACAAUCCUACAGGU | 2491-2513 | 1488 |
| AD-859640.1 | GUAACUGGAAGACAAACGGAA | 1758-1778 | 1399 | UUCCGUUUGUCUUCCAGUUACUU | 1756-1778 | 1489 |
| AD-859716.1 | UGCUCAUCACCUUGUACGCAA | 1834-1854 | 1400 | UUGCGUACAAGGUGAUGAGCAGG | 1832-1854 | 1490 |
| AD-859154.1 | AAUGACCAUACUCACUUCAGA | 1161-1181 | 1401 | UCUGAAGUGAGUAUGGUCAUUCU | 1159-1181 | 1491 |
| AD-860216.1 | GACCUGUAGGAUUGUUUUGAA | 2490-2510 | 1402 | UUCAAAACAAUCCUACAGGUCGC | 2488-2510 | 1492 |
| AD-859875.1 | AGAAUAGGUGAAAUUUGUUGA | 2045-2065 | 1403 | UCAACAAAUUUCACCUAUUCUAC | 2043-2065 | 1493 |
| AD-859079.1 | GCUGUGUUUGGUGGAUUUUAA | 1086-1106 | 1404 | UUAAAAUCCACCAAACACAGCAA | 1084-1106 | 1494 |
| AD-858827.1 | CCCAGAUAACCAGCUCGAACA | 754-774 | 1405 | UGUUCGAGCUGGUUAUCUGGGUG | 752-774 | 1495 |
| AD-860212.1 | UGGCGACCUGUAGGAUUGUUA | 2486-2506 | 1406 | UAACAAUCCUACAGGUCGCCAAC | 2484-2506 | 1496 |
| AD-859028.1 | GAGGCAUUUGGAUUUAAUCCA | 1035-1055 | 1407 | UGGAUUAAAUCCAAAUGCCUCUG | 1033-1055 | 1497 |
| AD-859161.1 | AUACUCACUUCAGGAAUGAUA | 1168-1188 | 1408 | UAUCAUUCCUGAAGUGAGUAUGG | 1166-1188 | 1498 |
| AD-858950.1 | UCCGGGAUUGAUUUUAACCA | 916-936 | 1409 | UGGUUAAAAUCAAUCCCAGGAGA | 914-936 | 1499 |
| AD-859162.1 | UACUCACUUCAGGAAUGAUGA | 1169-1189 | 1410 | UCAUCAUUCCUGAAGUGAGUAUG | 1167-1189 | 1500 |

TABLE 6-continued

Unmodified Sense and Antisense Strand Sequences of Solute carrier family 39 member 8 dsRNA Agents

| Duplex Name | Sense Sequence 5' to 3' | Target Region in NM_026228.5 | SEQ ID NO: | Antisense Sequence 5' to 3' | Target Region in NM_026228.5 | SEQ ID NO: |
| --- | --- | --- | --- | --- | --- | --- |
| AD-859243.1 | CGGACACAUCCACUUCGACAA | 1289-1309 | 1411 | UUGUCGAAGUGGAUGUGUCCGUU | 1287-1309 | 1501 |
| AD-859872.1 | UGUAGAAUAGGUGAAAUUUGA | 2042-2062 | 1412 | UCAAAUUUCACCUAUUCUACAUA | 2040-2062 | 1502 |
| AD-859242.1 | ACGGACACAUCCACUUCGACA | 1288-1308 | 1413 | UGUCGAAGUGGAUGUGUCCGUUA | 1286-1308 | 1503 |
| AD-859250.1 | AUCCACUUCGACACUGUCAGA | 1296-1316 | 1414 | UCUGACAGUGUCGAAGUGGAUGU | 1294-1316 | 1504 |
| AD-859009.1 | CAUUUUCCAGCUUAUUCCAGA | 1016-1036 | 1415 | UCUGGAAUAAGCUGGAAAAUGGC | 1014-1036 | 1505 |
| AD-859417.1 | UGAGGAGUUUCCUCAUGAGUA | 1517-1537 | 1416 | UACUCAUGAGGAAACUCCUCACA | 1515-1537 | 1506 |
| AD-859627.1 | GCUGAGAGAAAAAGUAACUGA | 1745-1765 | 1417 | UCAGUUACUUUUUCUCUCAGCAU | 1743-1765 | 1507 |
| AD-858947.1 | CUCUCCUGGGAUUGAUUUUAA | 913-933 | 1418 | UUAAAAUCAAUCCCAGGAGAGAG | 911-933 | 1508 |
| AD-859896.1 | UAAAAGGUUUUCGGUUUCAGA | 2079-2099 | 1419 | UCUGAAACCGAAAACCUUUUAAG | 2077-2099 | 1509 |
| AD-859429.1 | UGUGAUCUUGCUCAAUGCAGA | 1547-1567 | 1420 | UCUGCAUUGAGCAAGAUCACAAA | 1545-1567 | 1510 |
| AD-859026.1 | CAGAGGCAUUUGGAUUUAAUA | 1033-1053 | 1421 | UAUUAAAUCCAAAUGCCUCUGGA | 1031-1053 | 1511 |
| AD-859873.1 | GUAGAAUAGGUGAAAUUUGUA | 2043-2063 | 1422 | UACAAAUUUCACCUAUUCUACAU | 2041-2063 | 1512 |
| AD-859155.1 | AUGACCAUACUCACUUCAGGA | 1162-1182 | 1423 | UCCUGAAGUGAGUAUGGUCAUUC | 1160-1182 | 1513 |
| AD-859622.1 | GACAUGCUGAGAGAAAAAGUA | 1740-1760 | 1424 | UACUUUUUCUCUCAGCAUGUCGU | 1738-1760 | 1514 |
| AD-859590.1 | UUUCUCUGGCAGAUAUGUUUA | 1708-1728 | 1425 | UAAACAUAUCUGCCAGAGAAAUG | 1706-1728 | 1515 |
| AD-858949.1 | CUCCUGGGAUUGAUUUUAACA | 915-935 | 1426 | UGUUAAAAUCAAUCCCAGGAGAG | 913-935 | 1516 |
| AD-859020.1 | UUAUUCCAGAGGCAUUUGGAA | 1027-1047 | 1427 | UUCCAAAUGCCUCUGGAAUAAGC | 1025-1047 | 1517 |
| AD-860217.1 | ACCUGUAGGAUUGUUUUGAAA | 2491-2511 | 1428 | UUUCAAAACAAUCCUACAGGUCG | 2489-2511 | 1518 |
| AD-860523.1 | UGAGCAUAAUUAUUUAGCAGA | 2804-2824 | 1429 | UCUGCUAAAUAAUUAUGCUCAUC | 2802-2824 | 1519 |
| AD-859036.1 | UGGAUUUAAUCCCAAAAUUGA | 1043-1063 | 1430 | UCAAUUUUGGGAUUAAAUCCAAA | 1041-1063 | 1520 |
| AD-859430.1 | GUGAUCUUGCUCAAUGCAGGA | 1548-1568 | 1431 | UCCUGCAUUGAGCAAGAUCACAA | 1546-1568 | 1521 |
| AD-859082.1 | GUGUUUGGUGGAUUUUACAUA | 1089-1109 | 1432 | UAUGUAAAAUCCACCAAACACAG | 1087-1109 | 1522 |
| AD-859421.1 | GAGUUUCCUCAUGAGUUAGGA | 1521-1541 | 1433 | UCCUAACUCAUGAGGAAACUCCU | 1519-1541 | 1523 |
| AD-859594.1 | UCUGGCAGAUAUGUUUCCAGA | 1712-1732 | 1434 | UCUGGAAACAUAUCUGCCAGAGA | 1710-1732 | 1524 |
| AD-859071.1 | AAGCAGUUGCUGUGUUUGGUA | 1078-1098 | 1435 | UACCAAACACAGCAACUGCUUUC | 1076-1098 | 1525 |
| AD-860522.1 | AUGAGCAUAAUUAUUUAGCAA | 2803-2823 | 1436 | UUGCUAAAUAAUUAUGCUCAUCU | 2801-2823 | 1526 |
| AD-859718.1 | CUCAUCACCUUGUACGCAGGA | 1836-1856 | 1437 | UCCUGCGUACAAGGUGAUGAGCA | 1834-1856 | 1527 |
| AD-860246.1 | AAAGUAACAUGAAUUAGGAAA | 2520-2540 | 1438 | UUUCCUAAUUCAUGUUACUUUGU | 2518-2540 | 1528 |
| AD-860215.1 | CGACCUGUAGGAUUGUUUUGA | 2489-2509 | 1439 | UCAAAACAAUCCUACAGGUCGCC | 2487-2509 | 1529 |
| AD-859072.1 | AGCAGUUGCUGUGUUUGGUGA | 1079-1099 | 1440 | UCACCAAACACAGCAACUGCUUU | 1077-1099 | 1530 |
| AD-859714.1 | CCUGCUCAUCACCUUGUACGA | 1832-1852 | 1441 | UCGUACAAGGUGAUGAGCAGGAU | 1830-1852 | 1531 |
| AD-859717.1 | GCUCAUCACCUUGUACGCAGA | 1835-1855 | 1442 | UCUGCGUACAAGGUGAUGAGCAG | 1833-1855 | 1532 |
| AD-859119.1 | GAACACUAAGAUGCUACUGA | 1126-1146 | 1443 | UCAGUAGCAUCUUAAGUGUUCUC | 1124-1146 | 1533 |
| AD-860213.1 | GGCGACCUGUAGGAUUGUUUA | 2487-2507 | 1444 | UAAACAAUCCUACAGGUCGCCAA | 2485-2507 | 1534 |
| AD-858948.1 | UCUCCUGGGAUUGAUUUUAAA | 914-934 | 1445 | UUUAAAAUCAAUCCCAGGAGAGA | 912-934 | 1535 |
| AD-859081.1 | UGUGUUUGGUGGAUUUUACAA | 1088-1108 | 1446 | UUGUAAAAUCCACCAAACACAGC | 1086-1108 | 1536 |

TABLE 6-continued

Unmodified Sense and Antisense Strand Sequences of Solute carrier family 39 member 8 dsRNA Agents

| Duplex Name | Sense Sequence 5' to 3' | Target Region in NM_026228.5 | SEQ ID NO: | Antisense Sequence 5' to 3' | Target Region in NM_026228.5 | SEQ ID NO: |
|---|---|---|---|---|---|---|
| AD-859244.1 | GGACACAUCCACUUCGACACA | 1290-1310 | 1447 | UGUGUCGAAGUGGAUGUGUCCGU | 1288-1310 | 1537 |
| AD-859715.1 | CUGCUCAUCACCUUGUACGCA | 1833-1853 | 1448 | UGCGUACAAGGUGAUGAGCAGGA | 1831-1853 | 1538 |
| AD-859513.1 | AGCUUUCGGCAUUUUGGUGGA | 1631-1651 | 1449 | UCCACCAAAAUGCCGAAAGCUAG | 1629-1651 | 1539 |
| AD-859591.1 | UUCUCUGGCAGAUAUGUUUCA | 1709-1729 | 1450 | UGAAACAUAUCUGCCAGAGAAAU | 1707-1729 | 1540 |
| AD-859310.1 | CCCAAACUGUCAGAAAUAGGA | 1374-1394 | 1451 | UCCUAUUUCUGACAGUUUGGGCC | 1372-1394 | 1541 |
| AD-859639.1 | AGUAACUGGAAGACAAACGGA | 1757-1777 | 1452 | UCCGUUUGUCUUCCAGUUACUUU | 1755-1777 | 1542 |
| AD-858946.1 | UCUCUCCUGGGAUUGAUUUUA | 912-932 | 1453 | UAAAAUCAAUCCCAGGAGAGAGG | 910-932 | 1543 |
| AD-859662.1 | UCACCUUCUUCAUGAUCCAGA | 1780-1800 | 1454 | UCUGGAUCAUGAAGAAGGUGAAA | 1778-1800 | 1544 |
| AD-859593.1 | CUCUGGCAGAUAUGUUUCCAA | 1711-1731 | 1455 | UUGGAAACAUAUCUGCCAGAGAA | 1709-1731 | 1545 |
| AD-859512.1 | UAGCUUUCGGCAUUUUGGUGA | 1630-1650 | 1456 | UCACCAAAAUGCCGAAAGCUAGU | 1628-1650 | 1546 |
| AD-859638.1 | AAGUAACUGGAAGACAAACGA | 1756-1776 | 1457 | UCGUUUGUCUUCCAGUUACUUUU | 1754-1776 | 1547 |
| AD-859592.1 | UCUCUGGCAGAUAUGUUUCCA | 1710-1730 | 1458 | UGGAAACAUAUCUGCCAGAGAAA | 1708-1730 | 1548 |
| AD-859025.1 | CCAGAGGCAUUUGGAUUUAAA | 1032-1052 | 1459 | UUUAAAUCCAAAUGCCUCUGGAA | 1030-1052 | 1549 |
| AD-860561.1 | UGUGUCAGAGACUGAUGGUGA | 2865-2885 | 1460 | UCACCAUCAGUCUCUGACACAGC | 2863-2885 | 1550 |
| AD-860560.1 | CUGUGUCAGAGACUGAUGGUA | 2864-2884 | 1461 | UACCAUCAGUCUCUGACACAGCC | 2862-2884 | 1551 |
| AD-860521.1 | GAUGAGCAUAAUUAUUUAGCA | 2802-2822 | 1462 | UGCUAAAUAAUUAUGCUCAUCUU | 2800-2822 | 1552 |
| AD-859416.1 | GUGAGGAGUUUCCUCAUGAGA | 1516-1536 | 1463 | UCUCAUGAGGAAACUCCUCACAC | 1514-1536 | 1553 |
| AD-859420.1 | GGAGUUUCCUCAUGAGUUAGA | 1520-1540 | 1464 | UCUAACUCAUGAGGAAACUCCUC | 1518-1540 | 1554 |

TABLE 7

Modified Sense and Antisense Strand Sequences of Solute carrier family 39 member 8 (SLC39A8) dsRNA Agents

| Duplex ID | Sense Sequence 5'-3' | SEQ ID NO: | Antisense Sequence 5'-3' | SEQ ID NO: | mRNA Target Sequence 5'-3' | SEQ ID NO: |
|---|---|---|---|---|---|---|
| AD-858799.1 | ususuucuCfuUfCf AfugguuucucaL96 | 1555 | VPusGfsagaAfaCfCfaugaAfgAfgaaaasgsa | 1645 | UCUUUUCUCUUCAUGGUUUCUCA | 1735 |
| AD-858788.1 | csasgaagAfcAfUf CfuuuucucuuaL96 | 1556 | VPusAfsagaGfaAfAfagauGfuCfuucugscsu | 1646 | AGCAGAAGACAUCUUUUCUCUUC | 1736 |
| AD-859876.1 | gsasauagGfuGfAf AfauuuguuguaL96 | 1557 | VPusAfscaaCfaAfAfuuucAfcCfuauucsusa | 1647 | UAGAAUAGGUGAAAUUUGUUGUU | 1737 |
| AD-858795.1 | csasucuuUfuCfUf CfuucaugguuaL96 | 1558 | VPusAfsaccAfuGfAfagagAfaAfagaugsusc | 1648 | GACAUCUUUUCUCUUCAUGGUUU | 1738 |
| AD-859603.1 | usasuguuUfcCfAf GfagaugaacgaL96 | 1559 | VPusCfsguuCfaUfCfucugGfaAfacauasusc | 1649 | GAUAUGUUUCCAGAGAUGAACGA | 1739 |
| AD-858793.1 | gsascaucUfuUfUf CfucuucauggaL96 | 1560 | VPusCfscauGfaAfGfagaaAfaGfaugucsusu | 1650 | AAGACAUCUUUUCUCUUCAUGGU | 1740 |
| AD-858792.1 | asgsacauCfuUfUf UfcucuucaugaL96 | 1561 | VPusCfsaugAfaGfAfgaaaAfgAfugucususc | 1651 | GAAGACAUCUUUUCUCUUCAUGG | 1741 |
| AD-859877.1 | asasauagGfuGfAfAf AfuuuguuguuaL96 | 1562 | VPusAfsacaAfcAfAfauuuCfaCfuauuscsu | 1652 | AGAAUAGGUGAAAUUUGUUGUUA | 1742 |

TABLE 7-continued

Modified Sense and Antisense Strand Sequences of Solute carrier family 39 member 8 (SLC39A8) dsRNA Agents

| Duplex ID | Sense Sequence 5'-3' | SEQ ID NO: | Antisense Sequence 5'-3' | SEQ ID NO: | mRNA Target Sequence 5'-3' | SEQ ID NO: |
|---|---|---|---|---|---|---|
| AD-859893.1 | cscsuuaaAfaGfGf UfuuucgguuuaL96 | 1563 | VPusAfsaacCfgAfAfaaccUfuUfuaaggsasa | 1653 | UUCCUUAAAAGGUUUUCGGUUUC | 1743 |
| AD-859083.1 | usgsuuugGfuGfGf AfuuuuacaugaL96 | 1564 | VPusCfsaugUfaAfAfauccAfcCfaaacascsa | 1654 | UGUGUUUGGUGGAUUUUACAUGC | 1744 |
| AD-859006.1 | csgsccauUfuUfCf CfagcuuauucaL96 | 1565 | VPusGfsaauAfaGfCfuggaAfaAfuggcgsusu | 1655 | AACGCCAUUUUCCAGCUUAUUCC | 1745 |
| AD-858797.1 | uscsuuuuCfuCfUf UfcauguuucaL96 | 1566 | VPusGfsaaaCfcAfUfgaagAfgAfaaagasusg | 1656 | CAUCUUUUCUCUUCAUGGUUUCU | 1746 |
| AD-858794.1 | ascsaucuUfuUfCf UfcuucauggaL96 | 1567 | VPusAfsccaUfgAfAfgagaAfaAfgauguscsu | 1657 | AGACAUCUUUUCUCUUCAUGGUU | 1747 |
| AD-859804.1 | csasgaaaCfaUfCf UfccauagggaaL96 | 1568 | VPusUfscccUfaUfGfgagaUfgUfuucugsusg | 1658 | CACAGAAACAUCUCCAUAGGGAU | 1748 |
| AD-859008.1 | cscsauuuUfcCfAf GfcuuauuccaaL96 | 1569 | VPusUfsggaAfuAfAfgcugGfaAfauggscsg | 1659 | CGCCAUUUUCCAGCUUAUUCCAG | 1749 |
| AD-859080.1 | csusguguUfuGfGf UfggauuuuacaL96 | 1570 | VPusGfsuaaAfaUfCfcaccAfaAfcacagscsa | 1660 | UGCUGUGUUUGGUGGAUUUUACA | 1750 |
| AD-859878.1 | asusagguGfaAfAf UfuuguuguuaaL96 | 1571 | VPusUfsaacAfaCfAfaauuUfcAfccuaususc | 1661 | GAAUAGGUGAAAUUUGUUGUUAA | 1751 |
| AD-858791.1 | asasgacaUfcUfUf UfucucuucauaL96 | 1572 | VPusAfsugaAfgAfGfaaaaGfaUfgucuuscsu | 1662 | AGAAGACAUCUUUUCUCUUCAUG | 1752 |
| AD-859628.1 | csusgagaGfaAfAf AfaguaacuggaL96 | 1573 | VPusCfscagUfuAfCfuuuuUfcUfcucagscsa | 1663 | UGCUGAGAGAAAAAGUAACUGGA | 1753 |
| AD-859027.1 | asgsaggcAfuUfUf GfgauuuaaucaL96 | 1574 | VPusGfsauuAfaAfUfccaaAfuGfccucusgsg | 1664 | CCAGAGGCAUUUGGAUUUAAUCC | 1754 |
| AD-859849.1 | asasucuaAfuGfAf CfugguuucagaL96 | 1575 | VPusCfsugaAfaCfCfagucAfuUfagauuscsc | 1665 | GGAAUCUAAUGACUGGUUUCAGA | 1755 |
| AD-859874.1 | usasgaauAfgGfUf GfaaauuuguuaL96 | 1576 | VPusAfsacaAfaUfUfucacCfuAfuucuascsa | 1666 | UGUAGAAUAGGUGAAAUUUGUUG | 1756 |
| AD-859093.1 | asusuuuaCfaUfGf CfuuuucuuugaL96 | 1577 | VPusCfsaaaGfaAfAfagcaUfgUfaaaauscsc | 1667 | GGAUUUUACAUGCUUUUCUUUGU | 1757 |
| AD-860219.1 | csusguagGfaUfUf GfuuuugaaagaL96 | 1578 | VPusCfsuuuCfaAfAfacaaUfcCfuacagsgsu | 1668 | ACCUGUAGGAUUGUUUUGAAAGC | 1758 |
| AD-859640.1 | gsusaacuGfgAfAf GfacaaacggaaL96 | 1579 | VPusUfsccgUffuUfGfucuuCfcAfguuacsusu | 1669 | AAGUACUGGAAGACAAACGGAU | 1759 |
| AD-859716.1 | usgscucaUfcAfCf CfuuguacgcaaL96 | 1580 | VPusUfsgcgUfaCfAfagguGfaUfgagcasgsg | 1670 | CCUGCUCAUCACCUUGUACGCAG | 1760 |
| AD-859154.1 | asasugacCfaUfAf CfucacuucaggL96 | 1581 | VPusCfsugaAfgUfGfaguaUfgGfucauuscsu | 1671 | AGAAUGACCAUACUCACUUCAGG | 1761 |

TABLE 7-continued

Modified Sense and Antisense Strand Sequences of Solute carrier family 39 member 8 (SLC39A8) dsRNA Agents

| Duplex ID | Sense Sequence 5'-3' | SEQ ID NO: | Antisense Sequence 5'-3' | SEQ ID NO: | mRNA Target Sequence 5'-3' | SEQ ID NO: |
|---|---|---|---|---|---|---|
| AD-860212.1 | usgsgcgaCfcUfGf1586 UfaggauuguuaL96 | 1586 | VPusAfsacaAfuCfCfuacaGfgUfcgccasasc1676 | 1676 | GUUGGCGACCUGUAGGAUUGUUU | 1766 |
| AD-859028.1 | gsasggcaUfuUfGf1587 GfauuuaauccaL96 | 1587 | VPusGfsgauUfaAfAfuccaAfaUfgccucsusg1677 | 1677 | CAGAGGCAUUUGGAUUUAAUCCC | 1767 |
| AD-859161.1 | asusacucAfcUfUf1588 CfaggaaugauaL96 | 1588 | VPusAfsucaUfcCfCfugaaGfuGfaguausgsg1678 | 1678 | CCAUACUCACUUCAGGAAUGAUG | 1768 |
| AD-858950.1 | uscscuggGfaUfUf1589 GfauuuuaaccaL96 | 1589 | VPusGfsguuAfaAfAfucaaUfcCfcaggasgsa1679 | 1679 | UCUCCUGGGAUUGAUUUUAACCC | 1769 |
| AD-859162.1 | usascucaCfuUfCf1590 AfggaaugaugaL96 | 1590 | VPusCfsaucAfuUfCfcugaAfgUfgaguasusg1680 | 1680 | CAUACUCACUUCAGGAAUGAUGA | 1770 |
| AD-859243.1 | csgsgacaCfaUfCf1591 CfacuucgacaaL96 | 1591 | VPusUfsgucGfaAfGfuggaUfgUfguccgsusu1681 | 1681 | AACGGACACAUCCACUUCGACAC | 1771 |
| AD-859872.1 | usgsuagaAfuAfGf1592 GfugaaauuugaL96 | 1592 | VPusCfsaaaUfuUfCfaccuAfuUfcuacasusa1682 | 1682 | UAUGUAGAAUAGGUGAAAUUUGU | 1772 |
| AD-859242.1 | ascsggacAfcAfUf1593 CfcacuucgacaL96 | 1593 | VPusGfsucgAfaGfUfggauGfuGfuccgsusa1683 | 1683 | UAACGGACACAUCCACUUCGACA | 1773 |
| AD-859250.1 | asusccacUfuCfGf1594 AfcacugucagaL96 | 1594 | VPusCfsugaCfaGfUfgucgAfaGfuggausgsu1684 | 1684 | ACAUCCACUUCGACACUGUCAGC | 1774 |
| AD-859009.1 | csasuuuuCfcAfGf1595 CfuuauuccagaL96 | 1595 | VPusCfsuggAfaUfAfagcuGfgAfaaaugsgsc1685 | 1685 | GCCAUUUCCAGCUUAUUCCAGA | 1775 |
| AD-859417.1 | usgsaggaGfuUfUf1596 CfcucaugaguaL96 | 1596 | VPusAfscucAfuGfAfggaaAfcUfccucascsa1686 | 1686 | UGUGAGGAGUUUCCUCAUGAGUU | 1776 |
| AD-859627.1 | gscsugagAfgAfAf1597 AfaaguaacugaL96 | 1597 | VPusCfsaguUfaCfUfuuuuCfuCfucagcsasu1687 | 1687 | AUGCUGAGAGAAAAGUAACUGG | 1777 |
| AD-858947.1 | csuscuccUfgGfGf1598 AfuugauuuuaaL96 | 1598 | VPusUfsaaaAfuCfAfauccCfaGfgagagsasg1688 | 1688 | CUCUCUCCUGGGAUUGAUUUUAA | 1778 |
| AD-859896.1 | usasaaagGfuUfUf1599 UfcgguucagaL96 | 1599 | VPusCfsugaAfaCfCfgaaaAfcCfuuuuasasg1689 | 1689 | CUUAAAAGGUUUUCGGUUUCAGA | 1779 |
| AD-859429.1 | usgsugauCfuUfGf1600 CfucaaugcagaL96 | 1600 | VPusCfsugcAfuUfGfagcaAfgAfucacasasa1690 | 1690 | UUUGUGAUCUUGCUCAAUGCAGG | 1780 |
| AD-859026.1 | csasgaggCfaUfUf1601 UfggauuuaauaL96 | 1601 | VPusAfsuuaAfaUfCfcaaaUfgCfcucugsgsa1691 | 1691 | UCCAGAGGCAUUUGGAUUUAAUC | 1781 |
| AD-859873.1 | gsusagaaUfaGfGf1602 UfgaaauuguaL96 | 1602 | VPusAfscaaAfuUfUfcaccUfaUfucuacsasu1692 | 1692 | AUGUAGAAUAGGUGAAAUUUGUU | 1782 |
| AD-859155.1 | asusgaccAfuAfCf1603 UfcacuucaggaL96 | 1603 | VPusCfscugAfaGfUfgaguAfuGfgucaususc1693 | 1693 | GAAUGACCAUACUCACUUCAGGA | 1783 |
| AD-859622.1 | gsascaugCfuGfAf1604 GfagaaaaguaL96 | 1604 | VPusAfscuuUfuUfCfucucAfgCfaugucsgsu1694 | 1694 | ACGACAUGCUGAGAGAAAAGUA | 1784 |
| AD-859590.1 | ususucucUfgGfCf1605 AfgauauguuuaL96 | 1605 | VPusAfsaacAfuAfUfcugcCfaGfagaaasusg1695 | 1695 | CAUUUCUCUGGCAGAUAUGUUUC | 1785 |
| AD-858949.1 | csusccugGfgAfUf1606 UfgauuuuaacaL96 | 1606 | VPusGfsuuaAfaAfUfcaauCfcCfaggagsasg1696 | 1696 | CUCUCCUGGGAUUGAUUUUAACC | 1786 |
| AD-859020.1 | ususuauucCfaGfAf1607 GfgcauuuggaaL96 | 1607 | VPusUfsccaAfaUfGfccucUfgGfaauaasgsc1697 | 1697 | GCUUAUUCCAGAGGCAUUUGGAU | 1787 |
| AD-860217.1 | ascscuguAfgGfAf1608 UfuguuuugaaaL96 | 1608 | VPusUfsucaAfaAfCfaaucCfuAfcagguscsg1698 | 1698 | CGACCUGUAGGAUUGUUUUGAAA | 1788 |

TABLE 7-continued

Modified Sense and Antisense Strand Sequences of Solute carrier family 39 member 8 (SLC39A8) dsRNA Agents

| Duplex ID | Sense Sequence 5'-3' | SEQ ID NO: | Antisense Sequence 5'-3' | SEQ ID NO: | mRNA Target Sequence 5'-3' | SEQ ID NO: |
|---|---|---|---|---|---|---|
| AD-860523.1 | usgsagcaUfaAfUfauuuagcagaL96 | 1609 | VPusCfsugcUfaAfAfuaauUfaUfgcucasasusc | 1699 | GAUGAGCAUAAUUAUUUAGCAGG | 1789 |
| AD-859036.1 | usgsgauuUfaAfUfCfccaaaauugaL96 | 1610 | VPusCfsaauUfuUfGfggauUfaAfauccasasa | 1700 | UUUGGAUUUAAUCCCAAAAUUGA | 1790 |
| AD-859430.1 | gsusgaucUfuGfCfUfcaaugcaggaL96 | 1611 | VPusCfscugCfaUfUfgagcAfaGfaucacsasa | 1701 | UUGUGAUCUUGCUCAAUGCAGGA | 1791 |
| AD-859082.1 | gsusguuuGfgUfGfGfauuuuacauaL96 | 1612 | VPusAfsuguAfaAfAfuccaCfcAfaacacsasg | 1702 | CUGUGUUUGGUGGAUUUUACAUG | 1792 |
| AD-859421.1 | gsasguuuCfcUfCfAfugaguuaggaL96 | 1613 | VPusCfscuaAfcUfCfaugaGfgAfaacucscsu | 1703 | AGGAGUUUCCUCAUGAGUUAGGG | 1793 |
| AD-859594.1 | uscsuggcAfgAfUfAfuguuccagaL96 | 1614 | VPusCfsuggAfaAfCfauauCfuGfccagasgsa | 1704 | UCUCUGGCAGAUAUGUUUCCAGA | 1794 |
| AD-859071.1 | asasgcagUfuGfCfUfguguuuggaL96 | 1615 | VPusAfsccaAfaCfAfcagcAfaCfugcuususc | 1705 | GAAAGCAGUUGCUGUGUUUGGUG | 1795 |
| AD-860522.1 | asusgagcAfuAfAfUfuauuuagcaaL96 | 1616 | VPusUfsgcuAfaAfUfaauuAfuGfcucauscsu | 1706 | AGAUGAGCAUAAUUAUUUAGCAG | 1796 |
| AD-859718.1 | csuscaucAfcCfUfUfguacgcaggaL96 | 1617 | VPusCfscugCfgUfAfcaagGfuGfaugagscsa | 1707 | UGCUCAUCACCUUGUACGCAGGA | 1797 |
| AD-860246.1 | asasaguaAfcAfUfGfaauuaggaaaL96 | 1618 | VPusUfsuccUfaAfUfucauGfuUfacuuusgsu | 1708 | ACAAAGUAACAUGAAUUAGGAAA | 1798 |
| AD-860215.1 | csgsaccuGfuAfGfGfauuguuugaL96 | 1619 | VPusCfsaaaAfcAfAfuccuAfcAfggucgscsc | 1709 | GGCGACCUGUAGGAUUGUUUGA | 1799 |
| AD-859072.1 | asgscaguUfgCfUfUfguguuggugaL96 | 1620 | VPusCfsaccAfaAfCfacagCfaAfcugcususu | 1710 | AAAGCAGUUGCUGUGUUUGGUGG | 1800 |
| AD-859714.1 | cscsugcuCfaUfCfAfccuuguacgaL96 | 1621 | VPusCfsguaCfaAfGfgugaUfgAfgcaggsasu | 1711 | AUCCUGCUCAUCACCUUGUACGC | 1801 |
| AD-859717.1 | gscsucauCfaCfCfUfuguacgcagaL96 | 1622 | VPusCfsugcGfuAfCfaaggUfgAfugagcsasg | 1712 | CUGCUCAUCACCUUGUACGCAGG | 1802 |
| AD-859119.1 | gsasacacUfuAfAfGfaugcuacugaL96 | 1623 | VPusCfsaguAfgCfAfucuuAfaGfuguucsusc | 1713 | GAGAACACUUAAGAUGCUACUGA | 1803 |
| AD-860213.1 | gsgscgacCfuGfUfAfggauuguuuaL96 | 1624 | VPusAfsaacAfaUfCfcuacAfgGfucgccsasa | 1714 | UUGGCGACCUGUAGGAUUGUUUU | 1804 |
| AD-858948.1 | uscsuccuGfgGfAfUfugauuuuaaaL96 | 1625 | VPusUfsuaaAfaUfCfaaucCfcAfggagasgsa | 1715 | UCUCUCCUGGGAUUGAUUUUAAC | 1805 |
| AD-859081.1 | usgsuguuUfgGfUfGfgauuuuacaaL96 | 1626 | VPusUfsguaAfaAfUfccacCfaAfacacasgsc | 1716 | GCUGUGUUUGGUGGAUUUUACAU | 1806 |
| AD-859244.1 | gsgsacacAfuCfCfAfcuucgacacaL96 | 1627 | VPusGfsuguCfgAfAfguggAfuGfuguccsgsu | 1717 | ACGGACACAUCCACUUCGACACU | 1807 |
| AD-859715.1 | csusgcucAfuCfAfCfcuuguacgcaL96 | 1628 | VPusGfscguAfcAfAfggugAfuGfagcagsgsa | 1718 | UCCUGCUCAUCACCUUGUACGCA | 1808 |
| AD-859513.1 | asgscuuuCfgGfCfAfuuuugguggaL96 | 1629 | VPusCfscacCfaAfAfaugcCfgAfaagcusasg | 1719 | CUAGCUUUCGGCAUUUUGGUGGG | 1809 |
| AD-859591.1 | ususcucuGfgCfAfGfauauguuucaL96 | 1630 | VPusGfsaaaCfaUfAfucugCfcAfgagaasasu | 1720 | AUUUCUCUGGCAGAUAUGUUUCC | 1810 |
| AD-859310.1 | cscscaaaCfuGfUfCfagaaauaggaL96 | 1631 | VPusCfscuaUffuUfCfugacAfgUfuuggscscs | 1721 | GGCCCAAACUGUCAGAAAUAGGA | 1811 |

TABLE 7-continued

Modified Sense and Antisense Strand Sequences of Solute carrier family 39 member 8 (SLC39A8) dsRNA Agents

| Duplex ID | Sense Sequence 5'-3' | SEQ ID NO: | Antisense Sequence 5'-3' | SEQ ID NO: | mRNA Target Sequence 5'-3' | SEQ ID NO: |
|---|---|---|---|---|---|---|
| AD-859639.1 | asgsuaacUfgGfAf AfgacaaacggaL96 | 1632 | VPusCfscguUfuGfUfcuucCfaGfuuacususu1722 | 1722 | AAAGUAACUGGAAGACAAACGGA | 1812 |
| AD-858946.1 | uscsucucCfuGfGf Gfauugauuuual96 | 1633 | VPusAfsaaaUfcAfAfucccAfgGfagagasgsg | 1723 | CCUCUCUCCUGGGAUUGAUUUUA | 1813 |
| AD-859662.1 | uscsaccuUfcUfUf CfaugauccagaL96 | 1634 | VPusCfsuggAfuCfAfugaaGfaAfggugasasa | 1724 | UUUCACCUUCUUCAUGAUCCAGA | 1814 |
| AD-859593.1 | csuscuggCfaGfAf UfauguuuccaaL96 | 1635 | VPusUfsggaAfaCfAfuaucUfgCfcagagsasa | 1725 | UUCUCUGGCAGAUAUGUUUCCAG | 1815 |
| AD-859512.1 | usasgcuuUfcGfGf CfauuuuggugaL96 | 1636 | VPusCfsaccAfaAfAfugccGfaAfagcuasgsu | 1726 | ACUAGCUUUCGGCAUUUUGGUGG | 1816 |
| AD-859638.1 | asasguaaCfuGfGf AfagacaaacgaL96 | 1637 | VPusCfsguuUfgUfCfuuccAfgUfacuususu | 1727 | AAAGUAACUGGAAGACAAACGG | 1817 |
| AD-859592.1 | uscsucugGfcAfGf AfuauguuuccaL96 | 1638 | VPusGfsgaaAfcAfUfaucuGfcCfagagasasa | 1728 | UUCUCUGGCAGAUAUGUUUCCA | 1818 |
| AD-859025.1 | cscsagagGfcAfUf UfuggauuuaaaL96 | 1639 | VPusUfsuaaAfuCfCfaaauGfcCfucuggsasa | 1729 | UUCCAGAGGCAUUUGGAUUUAAU | 1819 |
| AD-860561.1 | usgsugucAfgAfGf AfcugauggugaL96 | 1640 | VPusCfsaccAfuCfAfgucuCfuGfacacasgsc | 1730 | GCUGUGUCAGAGACUGAUGGUGG | 1820 |
| AD-860560.1 | csusuguguCfaGfAf GfacugauggaL96 | 1641 | VPusAfsccaUfcAfGfucucUfgAfcacagscsc | 1731 | GGCUGUGUCAGAGACUGAUGGUG | 1821 |
| AD-860521.1 | gsasugagCfaUfAf AfuuauuuagcaL96 | 1642 | VPusGfscuaAfaUfAfauuaUfgCfucaucsusu | 1732 | AAGAUGAGCAUAAUUAUUUAGCA | 1822 |
| AD-859416.1 | gsusgaggAfgUfUf UfccucaugagaL96 | 1643 | VPusCfsucaUfgAfGfgaaaCfuCfcucacsasc | 1733 | GUGUGAGGAGUUUCCUCAUGAGU | 1823 |
| AD-859420.1 | gsgsaguuUfcCfUf CfaugauuagaL96 | 1644 | VPusCfsuaaCfuCfAfugagGfaAfacuccsusc | 1734 | GAGGAGUUUCCUCAUGAGUUAGG | 1824 |

TABLE 8

Unmodified Sense and Antisense Strand Sequences of Solute carrier family 39 member 8 (SLC39A8) dsRNA Agents

| Duplex Name | Sense Sequence 5' to 3' | Target Region | SEQ ID NO: | Antisense Sequence 5' to 3' | Target Region in NM_026228.5 | SEQ ID NO: |
|---|---|---|---|---|---|---|
| AD-859080.2 | CUGUGUUUGGUGGAUUUUACA | NM_026228.5_ 1087-1107_ A21U_s | 1825 | UGUAAAAUCCACCAAACACAGCA | NM_026228.5_ 1085-1107_ U1A_as | 1847 |
| AD-859076.1 | GUUGCUGUGUUUGGUGGAUUA | NM_026228.5_ 1083-1103_s | 1826 | UAAUCCACCAAACACAGCAACUG | NM_026228.5_ 1081-1103_as | 1848 |
| AD-888290.1 | CAGUUGCUGUGUUUGGUGGAA | NM_026228.5_ 1081-1101_s | 1827 | UUCCACCAAACACAGCAACUGCC | NM_001135146.2_ 985-1007_as | 1849 |
| AD-859079.2 | GCUGUGUUUGGUGGAUUUUAA | NM_026228.5_ 1086-1106_ C21U_s | 1828 | UUAAAAUCCACCAAACACAGCAA | NM_026228.5_ 1084-1106_ G1A_as | 1850 |
| AD-888238.1 | UUAUUCCAGAGGCAUUUGGAA | NM_026228.5_ 1027-1047_s | 1829 | UUCCAAAUGCCUCUGGAAUAAGU | NM_001135146.2_ 931-953_as | 1851 |
| AD-859075.1 | AGUUGCUGUGUUUGGUGGAUA | NM_026228.5_ 1082-1102_s | 1830 | UAUCCACCAAACACAGCAACUGC | NM_026228.5_ 1080-1102_as | 1852 |
| AD-859022.1 | AUUCCAGAGGCAUUUGGAUUA | NM_026228.5_ 1029-1049_s | 1831 | UAAUCCAAAUGCCUCUGGAAUAA | NM_026228.5_ 1027-1049_as | 1853 |

TABLE 8-continued

Unmodified Sense and Antisense Strand Sequences of Solute carrier family 39 member 8 (SLC39A8) dsRNA Agents

| Duplex Name | Sense Sequence 5' to 3' | Target Region | SEQ ID NO: | Antisense Sequence 5' to 3' | Target Region in NM_026228.5 | SEQ ID NO: |
|---|---|---|---|---|---|---|
| AD-859593.2 | CUCUGGCAGAUAUGUUUCCAA | NM_026228.5_1711-1731_G21U_s | 1832 | UUGGAAACAUAUCUGCCAGAGAA | NM_026228.5_1709-1731_C1A_as | 1854 |
| AD-888300.1 | GGCAGUUGCUGUGUUUGGUGA | NM_001135146.2_985-1005_G21U_s | 1833 | UCACCAAACACAGCAACUGCCUU | NM_001135146.2_983-1005_C1A_as | 1855 |
| AD-888299.1 | AGGCAGUUGCUGUGUUUGGUA | NM_001135146.2_984-1004_G21U_s | 1834 | UACCAAACACAGCAACUGCCUUC | NM_001135146.2_982-1004_C1A_as | 1856 |
| AD-859594.2 | UCUGGCAGAUAUGUUUCCAGA | NM_026228.5_1712-1732_A21U_s | 1835 | UCUGGAAACAUAUCUGCCAGAGA | NM_026228.5_1710-1732_U1A_as | 1857 |
| AD-888237.1 | CUUAUUCCAGAGGCAUUUGGA | NM_026228.5_1026-1046_A21U_s | 1836 | UCCAAAUGCCUCUGGAAUAAGUU | NM_001135146.2_930-952_U1A_as | 1858 |
| AD-859310.2 | CCCAAACUGUCAGAAAUAGGA | NM_026228.5_1374-1394_A21U_s | 1837 | UCCUAUUUCUGACAGUUUGGGCC | NM_026228.5_1372-1394_U1A_as | 1859 |
| AD-859591.2 | UUCUCUGGCAGAUAUGUUUCA | NM_026228.5_1709-1729_C21U_s | 1838 | UGAAACAUAUCUGCCAGAGAAAU | NM_026228.5_1707-1729_G1A_as | 1860 |
| AD-888249.1 | ACUUAUUCCAGAGGCAUUUGA | NM_001135146.2_931-951_G21U_s | 1839 | UCAAAUGCCUCUGGAAUAAGUUG | NM_001135146.2_929-951_C1A_as | 1861 |
| AD-859592.2 | UCUCUGGCAGAUAUGUUUCCA | NM_026228.5_1710-1730_A21U_s | 1840 | UGGAAACAUAUCUGCCAGAGAAA | NM_026228.5_1708-1730_U1A_as | 1862 |
| AD-859309.1 | GCCCAAACUGUCAGAAAUAGA | NM_026228.5_1373-1393_G21U_s | 1841 | UCUAUUUCUGACAGUUUGGGCCC | NM_026228.5_1371-1393_C1A_as | 1863 |
| AD-888289.1 | GCAGUUGCUGUGUUUGGUGGA | NM_026228.5_1080-1100_A21U_s | 1842 | UCCACCAAACACAGCAACUGCCU | NM_001135146.2_984-1006_U1A_as | 1864 |
| AD-888748.1 | AUUUCUCUGGCAGAUAUGUUA | NM_026228.5_1707-1727_s | 1843 | UAACAUAUCUGCCAGAGAAAUAU | NM_001135146.2_1605-1627_as | 1865 |
| AD-888784.1 | UAUUUCUCUGGCAGAUAUGUA | NM_001135146.2_1606-1626_s | 1844 | UACAUAUCUGCCAGAGAAAUAUA | NM_001135146.2_1604-1626_as | 1866 |
| AD-888749.1 | UUUCUCUGGCAGAUAUGUUUA | NM_026228.5_1708-1728_C21U_s | 1845 | UAAACAUAUCUGCCAGAGAAAUA | NM_001135146.2_1606-1628_G1A_as | 1867 |
| AD-888783.1 | AUAUUUCUCUGGCAGAUAUGA | NM_001135146.2_1605-1625_s | 1846 | UCAUAUCUGCCAGAGAAAUAUAG | NM_001135146.2_1603-1625_as | 1868 |

TABLE 9

Modified Sense and Antisense Strand Sequences of Solute carrier family 39 member 8 (SLC39A8) dsRNA Agents

| Duplex Name | Sense Sequence 5'-3' | SEQ ID NO: | Antisense Sequence 5'-3' | SEQ ID NO: | mRNA Target Sequence 5'-3' | SEQ ID NO: |
|---|---|---|---|---|---|---|
| AD-859080.2 | csusguguUfuGfGf1869 Ufggauuuuacal96 | 1869 | VPusGfsuaaAfaUfCfcaccAfaAfcacagscsa1891 | 1891 | UGCUGUGUUUGGUGGAUUUUACA | 1913 |

TABLE 9-continued

Modified Sense and Antisense Strand Sequences of Solute carrier family 39 member 8 (SLC39A8) dsRNA Agents

| Duplex Name | Sense Sequence 5'-3' | SEQ ID NO: | Antisense Sequence 5'-3' | SEQ ID NO: | mRNA Target Sequence 5'-3' | SEQ ID NO: |
|---|---|---|---|---|---|---|
| AD-859076.1 | gsusugcuGfuGfUf UfuggguggauuaL96 | 1870 | VPusAfsaucCfaCfCfaaacAfcAfgcaacsusg | 1892 | CAGUUGCUGUGUUUGGUGGAUUU | 1914 |
| AD-888290.1 | csasguugCfuGfUf GfuuugguggaaL96 | 1871 | VPusUfsccaCfcAfAfacacAfgCfaacugscsc | 1893 | AGCAGUUGCUGUGUUUGGUGGAU | 1915 |
| AD-859079.2 | gscsugugUfuUfGf GfuggauuuuaL96 | 1872 | VPusUfsaaaAfuCfCfaccaAfaCfacagcsasa | 1894 | UUGCUGUGUUUGGUGGAUUUUAC | 1916 |
| AD-888238.1 | ususauucCfaGfAf GfgcauuuggaaL96 | 1873 | VPusUfsccaAfaUfGfccucUfgGfaauaasgsu | 1895 | GCUUAUUCCAGAGGCAUUUGGAU | 1917 |
| AD-859075.1 | asgsuugcUfgUfGf UfuuggguggauaL96 | 1874 | VPusAfsuccAfcCfAfaacaCfaGfcaacusgsc | 1896 | GCAGUUGCUGUGUUUGGUGGAUU | 1918 |
| AD-859022.1 | asusuccaGfaGfGf CfauuuggauuaL96 | 1875 | VPusAfsaucCfaAfAfugccUfcUfggaausasa | 1897 | UUAUUCCAGAGGCAUUUGGAUUU | 1919 |
| AD-859593.2 | csuscuggCfaGfAf UfauguuuccaaL96 | 1876 | VPusUfsggaAfaCfAfuaucUfgCfcagagsasa | 1898 | UUCUCUGGCAGAUAUGUUUCCAG | 1920 |
| AD-888300.1 | gsgscaguUfgCfUf GfuguuugguguaL96 | 1877 | VPusCfsaccAfaAfCfacagCfaAfcugccsusu | 1899 | AAGGCAGUUGCUGUGUUUGGUGG | 1921 |
| AD-888299.1 | asgsgcagUfuGfCf UfuguuugguaL96 | 1878 | VPusAfsccaAfaCfAfcagcAfaCfugccususc | 1900 | GAAGGCAGUUGCUGUGUUUGGUG | 1922 |
| AD-859594.2 | uscsuggcAfgAfUf AfuguuuccagaL96 | 1879 | VPusCfsuggAfaAfCfauauCfuGfccagasgsa | 1901 | UCUCUGGCAGAUAUGUUUCCAGA | 1923 |
| AD-888237.1 | csusuauuCfcAfGf AfggcauuuggaL96 | 1880 | VPusCfscaaAfuGfCfcucuGfgAfauaagsusu | 1902 | CUUAUUCCAGAGGCAUUUGGAUU | 1924 |
| AD-859310.2 | cscscaaaCfuGfUf CfagaaauaggaL96 | 1881 | VPusCfscuaUfuUfCfugacAfgUfuugggscsc | 1903 | GGCCCAAACUGUCAGAAAUAGGA | 1925 |
| AD-859591.2 | ususcucuGfgCfAf GfauauguuucaL96 | 1882 | VPusGfsaaaCfaUfAfucugCfcAfgagaasasu | 1904 | AUUUCUCUGGCAGAUAUGUUUCC | 1926 |
| AD-888249.1 | ascsuuauUfcCfAf GfaggcauuugaL96 | 1883 | VPusCfsaaaUfgCfCfucugGfaAfuaagususg | 1905 | CAACUUAUUCCAGAGGCAUUUGG | 1927 |
| AD-859592.2 | uscsucugGfcAfGf AfuauguuuccaL96 | 1884 | VPusGfsgaaAfcAfUfaucuGfcCfagagasasa | 1906 | UUUCUCUGGCAGAUAUGUUUCCA | 1928 |
| AD-859309.1 | gscsccaaAfcUfGf UfcagaaauagaL96 | 1885 | VPusCfsuauUfuCfUfugacAfgUfugggcscsc | 1907 | GGGCCCAAACUGUCAGAAAUAGG | 1929 |
| AD-888289.1 | gscsaguuGfcUfGf UfguuuggugaL96 | 1886 | VPusCfscacCfaAfAfcacaGfcAfacugcscsu | 1908 | AAGCAGUUGCUGUGUUUGGUGGA | 1930 |
| AD-888748.1 | asusuucuCfuGfGf CfagauauguuaL96 | 1887 | VPusAfsacaUfaUfCfugccAfgAfgaaausasu | 1909 | ACAUUUCUCUGGCAGAUAUGUUU | 1931 |
| AD-888784.1 | usasuuucUfcUfGf GfcagauaugaL96 | 1888 | VPusAfscauAfuCfUfgccaGfaGfaaauasusa | 1910 | UAUAUUUCUCUGGCAGAUAUGUU | 1932 |
| AD-888749.1 | ususucucUfgGfCf AfgauauguuaL96 | 1889 | VPusAfsaacAfuAfUfcugcCfaGfagaaausa | 1911 | CAUUUCUCUGGCAGAUAUGUUUC | 1933 |
| AD-888783.1 | asusauuuCfuCfUf GfgcagauaugaL96 | 1890 | VPusCfsauaUfcUfGfccagAfgAfaauausasg | 1912 | CUAUAUUUCUCUGGCAGAUAUGU | 1934 |

TABLE 10

SLC39A8 Single Dose Screen Results in Primary Mouse Hepatocytes (PMH)
Primary Mouse Hepatocytes

| Duplex ID | 50 nM | | 10 nM | | 1 nM | | 0.1 nM | |
| --- | --- | --- | --- | --- | --- | --- | --- | --- |
| | % Message Remaining | Std. Dev. | % Message Remaining | Std. Dev. | % Message Remaining | Std. Dev. | % Message Remaining | Std. Dev. |
| AD-859080.2 | 7.71 | 1.63 | 10.83 | 0.74 | 20.48 | 6.51 | 28.50 | 9.81 |
| AD-859076.1 | 5.64 | 2.77 | 13.87 | 4.64 | 24.42 | 3.28 | 53.36 | 7.79 |
| AD-888290.1 | 9.58 | 0.56 | 11.81 | 4.05 | 25.87 | 6.71 | 32.75 | 1.26 |
| AD-859079.2 | 2.86 | 0.53 | 18.04 | 2.53 | 27.55 | 2.33 | 54.13 | 8.41 |
| AD-888238.1 | 13.36 | 4.55 | 17.30 | 3.42 | 32.54 | 4.81 | 61.31 | 7.62 |
| AD-859075.1 | 14.05 | 10.01 | 19.07 | 2.77 | 33.05 | 5.36 | 51.19 | 8.94 |
| AD-859022.1 | 19.84 | 0.58 | 28.22 | 1.21 | 34.77 | 3.89 | 39.38 | 19.36 |
| AD-859593.2 | 18.47 | 1.19 | 26.57 | 1.42 | 37.84 | 3.23 | 56.26 | 9.49 |
| AD-888300.1 | 9.19 | 3.31 | 20.50 | 1.94 | 40.27 | 4.39 | 74.39 | 4.45 |
| AD-888299.1 | 8.64 | 1.79 | 22.29 | 3.09 | 41.13 | 7.00 | 44.57 | 8.53 |
| AD-859594.2 | 20.95 | 0.96 | 30.98 | 3.13 | 48.41 | 6.54 | 77.39 | 11.80 |
| AD-888237.1 | 20.27 | 5.07 | 34.50 | 2.73 | 57.98 | 3.87 | 71.98 | 11.96 |
| AD-859310.2 | 20.75 | 3.05 | 35.72 | 5.17 | 58.83 | 6.24 | 67.87 | 14.75 |
| AD-859591.2 | 25.65 | 9.82 | 43.75 | 4.58 | 59.46 | 5.02 | 77.14 | 8.43 |
| AD-888249.1 | 54.84 | 7.29 | 53.20 | 1.80 | 59.75 | 8.59 | 55.05 | 8.07 |
| AD-859592.2 | 21.24 | 5.70 | 37.19 | 3.25 | 61.80 | 5.66 | 92.29 | 10.82 |
| AD-859309.1 | 24.59 | 7.85 | 51.00 | 7.75 | 78.68 | 5.67 | 103.80 | 17.13 |
| AD-888289.1 | 12.71 | 5.31 | 44.35 | 6.11 | 81.56 | 14.58 | 96.68 | 6.61 |
| AD-888748.1 | 73.27 | 8.61 | 76.24 | 5.12 | 82.54 | 7.43 | 82.33 | 6.48 |
| AD-888784.1 | 57.20 | 11.53 | 74.38 | 4.29 | 91.41 | 11.74 | 70.32 | 8.70 |
| AD-888749.1 | 59.95 | 13.58 | 59.67 | 14.00 | 100.47 | 7.46 | 84.54 | 9.52 |
| AD-888783.1 | 118.95 | 6.54 | 104.39 | 44.33 | 117.45 | 12.15 | 59.32 | 18.09 |

TABLE 11

SLC39A8 Single Dose Screen in Cos-7 Cells (Human Dual-Luciferase psiCHECK2 vector)
Human Vector Dual Luc

| Duplex ID | 50 nM | | 10 nM | | 1 nM | | 0.1 nM | |
| --- | --- | --- | --- | --- | --- | --- | --- | --- |
| | % Message Remaining | Std. Dev. | % Message Remaining | Std. Dev. | % Message Remaining | Std. Dev. | % Message Remaining | Std. Dev. |
| AD-859080.2 | 22.16 | 6.31 | 19.99 | 1.12 | 28.32 | 0.97 | 56.15 | 7.60 |
| AD-859079.2 | 19.59 | 1.79 | 22.78 | 2.07 | 33.84 | 3.32 | 63.82 | 9.69 |
| AD-859076.1 | 24.13 | 4.31 | 25.99 | 2.27 | 40.22 | 5.40 | 68.50 | 5.45 |
| AD-888290.1 | 25.37 | 1.28 | 26.92 | 6.45 | 43.64 | 7.49 | 80.78 | 15.67 |
| AD-859075.1 | 32.02 | 3.58 | 30.39 | 1.34 | 44.51 | 4.07 | 76.06 | 9.68 |
| AD-888300.1 | 28.47 | 5.71 | 30.49 | 1.57 | 45.83 | 5.15 | 90.17 | 2.91 |
| AD-859591.2 | 25.15 | 1.29 | 30.16 | 3.06 | 48.45 | 4.07 | 78.13 | 6.87 |
| AD-859592.2 | 20.32 | 2.13 | 27.86 | 2.75 | 48.67 | 5.08 | 90.92 | 0.95 |
| AD-888299.1 | 23.80 | 3.83 | 34.99 | 5.74 | 50.45 | 4.49 | 85.47 | 8.60 |
| AD-859593.2 | 24.42 | 1.50 | 30.01 | 3.48 | 51.05 | 6.08 | 76.53 | 8.76 |
| AD-859594.2 | 28.18 | 7.42 | 30.63 | 4.54 | 55.89 | 3.71 | 85.32 | 9.26 |
| AD-888784.1 | 23.79 | 4.22 | 33.25 | 3.76 | 56.67 | 7.78 | 87.08 | 10.89 |
| AD-888748.1 | 42.89 | 5.65 | 45.10 | 0.81 | 61.83 | 5.46 | 87.85 | 7.83 |
| AD-888289.1 | 34.20 | 4.01 | 34.62 | 5.17 | 62.64 | 7.58 | 78.05 | 4.66 |
| AD-888238.1 | 40.46 | 7.63 | 46.25 | 1.63 | 62.93 | 6.49 | 83.76 | 11.36 |
| AD-859310.2 | 47.10 | 6.27 | 52.00 | 2.31 | 71.63 | 10.22 | 92.11 | 12.12 |
| AD-859309.1 | 45.58 | 4.24 | 56.05 | 5.24 | 71.88 | 4.98 | 88.46 | 6.72 |
| AD-888237.1 | 46.95 | 7.71 | 51.38 | 7.89 | 72.28 | 9.52 | 101.60 | 11.17 |
| AD-888749.1 | 43.15 | 2.39 | 49.23 | 5.34 | 73.21 | 3.71 | 85.75 | 14.23 |
| AD-859022.1 | 39.11 | 8.85 | 48.22 | 6.06 | 73.40 | 7.61 | 95.88 | 4.82 |
| AD-888249.1 | 58.05 | 7.26 | 58.23 | 5.40 | 75.89 | 6.14 | 92.25 | 8.72 |
| AD-888783.1 | 90.04 | 20.66 | 80.92 | 3.20 | 89.57 | 16.19 | 111.21 | 2.58 |

TABLE 12

SLC39A8 Single Dose Screen Results in Primary Mouse Hepatocytes (PMH)

| Duplex ID | Dose - Unit 10 - nM Avg | SD | Dose - Unit 0.1 - nM Avg | SD |
|---|---|---|---|---|
| AD-858799.1 | 1.7 | 1.7 | 26.1 | 8.8 |
| AD-858788.1 | 1.9 | 1.8 | 37.5 | 10.4 |
| AD-859876.1 | 14.3 | 7.6 | 41.5 | 7.9 |
| AD-858795.1 | 3.0 | 2.5 | 44.7 | 18.4 |
| AD-859603.1 | 9.3 | 7.0 | 48.4 | 32.6 |
| AD-858793.1 | 5.1 | 5.2 | 48.6 | 32.9 |
| AD-858792.1 | 5.3 | 0.9 | 49.3 | 13.4 |
| AD-859877.1 | 8.1 | 2.6 | 49.5 | 7.9 |
| AD-859893.1 | 10.2 | 4.0 | 49.9 | 13.7 |
| AD-859083.1 | 4.3 | 2.2 | 51.1 | 24.5 |
| AD-859006.1 | 4.5 | 1.2 | 51.8 | 34.7 |
| AD-858797.1 | 2.4 | 0.7 | 52.1 | 15.1 |
| AD-858794.1 | 3.6 | 1.8 | 54.5 | 6.0 |
| AD-859804.1 | 20.4 | 1.9 | 57.7 | 38.7 |
| AD-859008.1 | 4.3 | 1.4 | 57.8 | 10.9 |
| AD-859080.1 | 6.3 | 4.1 | 59.4 | 10.5 |
| AD-859878.1 | 10.7 | 4.0 | 60.1 | 11.8 |
| AD-858791.1 | 4.2 | 1.6 | 60.4 | 13.3 |
| AD-859628.1 | 11.1 | 3.9 | 63.2 | 35.0 |
| AD-859027.1 | 8.6 | 2.3 | 65.1 | 28.3 |
| AD-859849.1 | 9.8 | 5.8 | 65.9 | 11.6 |
| AD-859874.1 | 13.2 | 5.9 | 67.0 | 19.6 |
| AD-859093.1 | 16.2 | 16.6 | 68.2 | 20.1 |
| AD-860219.1 | 11.0 | 7.9 | 69.0 | 10.9 |
| AD-859640.1 | 12.5 | 6.2 | 70.3 | 29.3 |
| AD-859716.1 | 34.0 | 26.8 | 70.6 | 21.1 |
| AD-859154.1 | 5.7 | 3.8 | 70.9 | 18.8 |
| AD-860216.1 | 11.0 | 5.2 | 70.9 | 18.7 |
| AD-859875.1 | 9.4 | 3.0 | 71.5 | 10.2 |
| AD-859079.1 | 7.4 | 4.0 | 75.0 | 11.0 |
| AD-858827.1 | 6.7 | 1.9 | 75.1 | 18.4 |
| AD-860212.1 | 20.3 | 7.1 | 77.4 | 24.2 |
| AD-859028.1 | 3.9 | 2.1 | 78.1 | 11.5 |
| AD-859161.1 | 8.3 | 2.7 | 78.4 | 23.4 |
| AD-858950.1 | 3.4 | 0.9 | 78.7 | 22.0 |
| AD-859162.1 | 5.7 | 1.6 | 78.9 | 15.4 |
| AD-859243.1 | 19.2 | 0.5 | 79.1 | 25.1 |
| AD-859872.1 | 9.0 | 4.3 | 79.1 | 15.1 |
| AD-859242.1 | 7.4 | 3.3 | 79.1 | 17.9 |
| AD-859250.1 | 9.1 | 6.6 | 79.2 | 6.6 |
| AD-859009.1 | 5.4 | 1.8 | 79.4 | 11.9 |
| AD-859417.1 | 12.2 | 5.8 | 80.3 | 4.5 |
| AD-859627.1 | 9.2 | 5.7 | 80.6 | 21.4 |
| AD-858947.1 | 4.6 | 2.3 | 80.8 | 8.5 |
| AD-859896.1 | 12.1 | 3.0 | 80.9 | 14.6 |
| AD-859429.1 | 15.3 | 3.9 | 81.5 | 11.5 |
| AD-859026.1 | 9.4 | 3.5 | 83.0 | 33.5 |
| AD-859873.1 | 21.2 | 7.4 | 83.2 | 3.4 |
| AD-859155.1 | 7.3 | 2.3 | 83.4 | 12.2 |
| AD-859622.1 | 18.9 | 8.4 | 84.8 | 15.8 |
| AD-859590.1 | 25.2 | 14.3 | 85.0 | 22.3 |
| AD-858949.1 | 8.1 | 3.4 | 86.2 | 25.5 |
| AD-859020.1 | 5.8 | 3.6 | 86.3 | 24.4 |
| AD-860217.1 | 11.8 | 3.4 | 86.7 | 14.3 |
| AD-860523.1 | 20.6 | 5.4 | 87.8 | 15.1 |
| AD-859036.1 | 6.2 | 4.9 | 88.1 | 18.0 |
| AD-859430.1 | 17.6 | 3.3 | 88.1 | 14.5 |
| AD-859082.1 | 3.7 | 1.3 | 88.4 | 13.5 |
| AD-859421.1 | 16.4 | 6.9 | 88.9 | 4.2 |
| AD-859594.1 | 13.3 | 4.9 | 89.1 | 11.1 |
| AD-859071.1 | 6.2 | 2.0 | 89.1 | 13.4 |
| AD-860522.1 | 10.3 | 4.0 | 89.6 | 11.7 |
| AD-859718.1 | 63.6 | 23.9 | 90.3 | 29.5 |
| AD-860246.1 | 15.4 | 2.3 | 91.1 | 24.2 |
| AD-860215.1 | 17.9 | 4.1 | 91.4 | 12.7 |
| AD-859072.1 | 7.7 | 3.1 | 91.6 | 16.1 |
| AD-859714.1 | 18.8 | 4.4 | 91.8 | 5.7 |
| AD-859717.1 | 18.1 | 6.7 | 92.1 | 5.8 |
| AD-859119.1 | 15.8 | 5.2 | 92.8 | 21.7 |
| AD-860213.1 | 17.0 | 6.7 | 93.0 | 9.7 |
| AD-858948.1 | 8.6 | 4.0 | 94.0 | 20.5 |
| AD-859081.1 | 16.9 | 4.2 | 94.7 | 14.5 |
| AD-859244.1 | 6.4 | 3.5 | 96.2 | 6.3 |
| AD-859715.1 | 29.1 | 8.8 | 97.1 | 15.8 |
| AD-859513.1 | 22.4 | 3.2 | 99.2 | 26.7 |
| AD-859591.1 | 22.4 | 9.3 | 99.4 | 13.6 |
| AD-859310.1 | 24.2 | 8.0 | 100.2 | 4.9 |
| AD-859639.1 | 17.4 | 10.8 | 101.1 | 5.9 |
| AD-858946.1 | 6.6 | 3.9 | 101.2 | 9.0 |
| AD-859662.1 | 20.7 | 6.3 | 101.2 | 11.7 |
| AD-859593.1 | 11.4 | 3.9 | 101.4 | 10.4 |
| AD-859512.1 | 35.6 | 8.7 | 102.8 | 15.5 |
| AD-859638.1 | 13.9 | 6.3 | 102.9 | 11.3 |
| AD-859592.1 | 30.3 | 12.4 | 103.1 | 9.6 |
| AD-859025.1 | 6.0 | 1.0 | 104.4 | 10.0 |
| AD-860561.1 | 55.8 | 61.3 | 109.4 | 22.0 |
| AD-860560.1 | 25.3 | 7.8 | 112.3 | 16.9 |
| AD-860521.1 | 17.8 | 4.3 | 118.3 | 11.5 |
| AD-859416.1 | 101.2 | 6.5 | 128.3 | 11.8 |
| AD-859420.1 | 37.2 | 9.6 | 138.9 | 7.3 |

TABLE 13

SLC30A10 Single Dose Screen Results in Hep3B Cells

| DuplexID | % of Avg Message Remaining | STDEV |
|---|---|---|
| AD-1023162.1 | 89.8 | 7.1 |
| AD-1023184.1 | 96.4 | 3.4 |
| AD-1023195.1 | 119.5 | 8.9 |
| AD-1023230.1 | 60.2 | 9.4 |
| AD-1023255.1 | 58.2 | 6.9 |
| AD-1023273.1 | 59.0 | 1.9 |
| AD-1023313.1 | 42.2 | 1.4 |
| AD-1023339.1 | 37.1 | 3.2 |
| AD-1023357.1 | 68.3 | 2.6 |
| AD-1023407.1 | 103.7 | 2.6 |
| AD-1023429.1 | 125.0 | 19.9 |
| AD-1023459.1 | 41.8 | 6.1 |
| AD-1023467.1 | 50.7 | 4.4 |
| AD-1023474.1 | 62.8 | 7.3 |
| AD-1023488.1 | 33.3 | 1.9 |
| AD-1023526.1 | 33.1 | 1.3 |
| AD-1023539.1 | 50.4 | 1.3 |
| AD-1023559.1 | 45.5 | 5.4 |
| AD-1023575.1 | 66.1 | 11.7 |
| AD-1023588.1 | 48.4 | 11.6 |
| AD-1023600.1 | 44.5 | 3.7 |

TABLE 13-continued

SLC30A10 Single Dose Screen Results in Hep3B Cells

| DuplexID | % of Avg Message Remaining | STDEV |
| --- | --- | --- |
| AD-1023612.1 | 43.4 | 2.2 |
| AD-1023624.1 | 32.2 | 2.8 |
| AD-1023646.1 | 62.9 | 4.1 |
| AD-1023669.1 | 90.3 | 6.7 |
| AD-1023671.1 | 64.4 | 5.9 |
| AD-1023684.1 | 41.7 | 3.3 |
| AD-1023696.1 | 41.4 | 4.0 |
| AD-1023707.1 | 32.6 | 2.1 |
| AD-1023719.1 | 38.6 | 3.2 |
| AD-1023732.1 | 144.3 | 28.8 |
| AD-1023745.1 | 55.3 | 4.8 |
| AD-1023767.1 | 67.8 | 6.6 |
| AD-1023787.1 | 48.6 | 4.7 |
| AD-1023800.1 | 33.1 | 4.4 |
| AD-1023812.1 | 25.1 | 3.4 |
| AD-1023837.1 | 29.3 | 2.1 |
| AD-1023863.1 | 26.9 | 4.6 |
| AD-1023876.1 | 35.4 | 6.5 |
| AD-1023888.1 | 58.0 | 0.8 |
| AD-1023910.1 | 51.4 | 2.9 |
| AD-1023913.1 | 36.7 | 1.9 |
| AD-1023930.1 | 39.6 | 5.2 |
| AD-1023942.1 | 49.2 | 3.9 |
| AD-1023964.1 | 42.5 | 0.7 |
| AD-1023979.1 | 27.2 | 5.4 |
| AD-1023993.1 | 36.2 | 4.7 |
| AD-1024002.1 | 79.6 | 12.7 |
| AD-1024016.1 | 67.5 | 6.1 |
| AD-1024030.1 | 77.7 | 6.9 |
| AD-1024052.1 | 32.5 | 3.8 |
| AD-1024071.1 | 63.9 | 7.4 |
| AD-1024086.1 | 49.4 | 4.1 |
| AD-1024110.1 | 45.6 | 8.0 |
| AD-1024123.1 | 63.1 | 7.6 |
| AD-1024138.1 | 43.0 | 3.3 |
| AD-1024150.1 | 46.1 | 3.2 |
| AD-1024162.1 | 40.0 | 3.7 |
| AD-1024174.1 | 62.3 | 6.5 |
| AD-1024186.1 | 43.0 | 4.0 |
| AD-1024203.1 | 25.0 | 1.6 |
| AD-1024215.1 | 75.2 | 5.0 |
| AD-1024230.1 | 52.3 | 7.8 |
| AD-1024243.1 | 30.0 | 2.5 |
| AD-1024257.1 | 61.1 | 2.9 |
| AD-1024270.1 | 31.8 | 4.2 |
| AD-1024282.1 | 30.9 | 2.4 |
| AD-1024297.1 | 25.7 | 5.1 |
| AD-1024309.1 | 23.4 | 2.8 |
| AD-1024321.1 | 61.8 | 7.3 |
| AD-1024333.1 | 51.9 | 1.8 |
| AD-1024351.1 | 35.2 | 2.1 |
| AD-1024371.1 | 31.9 | 2.5 |
| AD-1024374.1 | 29.7 | 4.2 |
| AD-1024386.1 | 32.4 | 1.8 |
| AD-1024401.1 | 28.7 | 0.9 |
| AD-1024417.1 | 27.7 | 3.4 |
| AD-1024427.1 | 27.7 | 2.1 |
| AD-1024439.1 | 33.2 | 4.0 |
| AD-1024458.1 | 29.4 | 1.9 |
| AD-1024474.1 | 39.3 | 2.4 |
| AD-1024486.1 | 25.3 | 5.0 |
| AD-1024501.1 | 40.8 | 7.4 |
| AD-1024512.1 | 27.2 | 1.2 |
| AD-1024524.1 | 30.8 | 1.0 |
| AD-1024544.1 | 40.0 | 12.0 |
| AD-1024556.1 | 44.2 | 3.0 |
| AD-1024568.1 | 35.8 | 3.6 |
| AD-1024591.1 | 39.8 | 3.8 |
| AD-1024599.1 | 53.9 | 7.2 |
| AD-1024611.1 | 47.4 | 10.7 |
| AD-1024622.1 | 46.6 | 4.3 |
| AD-1024642.1 | 65.3 | 14.3 |
| AD-1024661.1 | 34.3 | 5.9 |
| AD-1024666.1 | 57.5 | 14.0 |
| AD-1024670.1 | 29.2 | 2.0 |
| AD-1024680.1 | 48.0 | 8.1 |
| AD-1024692.1 | 95.4 | 18.9 |
| AD-1024711.1 | 55.2 | 10.5 |
| AD-1024739.1 | 59.6 | 8.4 |
| AD-1024757.1 | 39.1 | 12.8 |
| AD-1024772.1 | 63.9 | 9.8 |
| AD-1024785.1 | 41.8 | 4.2 |
| AD-1024801.1 | 46.7 | 14.6 |
| AD-1024813.1 | 57.3 | 11.7 |
| AD-1024815.1 | 199.1 | 7.1 |
| AD-1024830.1 | 63.7 | 6.1 |
| AD-1024844.1 | 105.3 | 9.3 |
| AD-1024866.1 | 89.4 | 9.3 |
| AD-1024883.1 | 52.6 | 10.9 |
| AD-1024902.1 | 53.5 | 8.7 |
| AD-1024916.1 | 34.8 | 6.2 |
| AD-1024921.1 | 83.6 | 27.8 |
| AD-1024930.1 | 110.8 | 7.4 |
| AD-1024946.1 | 64.9 | 5.1 |
| AD-1024958.1 | 65.3 | 1.7 |
| AD-1024971.1 | 54.8 | 3.1 |
| AD-1024987.1 | 46.7 | 5.8 |
| AD-1025004.1 | 53.1 | 2.2 |
| AD-1025017.1 | 67.6 | 9.3 |
| AD-1025036.1 | 91.0 | 5.1 |
| AD-1025049.1 | 59.2 | 3.1 |
| AD-1025058.1 | 100.0 | 13.7 |
| AD-1025070.1 | 55.3 | 17.8 |
| AD-1025082.1 | 49.7 | 2.1 |
| AD-1025103.1 | 48.0 | 6.4 |
| AD-1025115.1 | 64.4 | 13.7 |
| AD-1025133.1 | 61.2 | 11.1 |
| AD-1025152.1 | 71.4 | 6.5 |
| AD-1025158.1 | 81.9 | 11.6 |
| AD-1025173.1 | 40.7 | 9.4 |
| AD-1025187.1 | 55.9 | 8.3 |
| AD-1025191.1 | 75.3 | 12.5 |
| AD-1025209.1 | 96.0 | 10.5 |

Example 3. SLC39A8 In Vivo Screen

Duplexes of interest, identified from the above in vitro studies, were evaluated in vivo. C57BL/6 mice (n=3) were subcutaneously administered a single 3 mg/kg dose of the agents of interest or PBS control. At day 7 post-dose, animals were sacrificed, liver samples were collected and snap-frozen in liquid nitrogen. Liver mRNA was extracted and analyzed by the RT-QPCR method.

Figure 2:
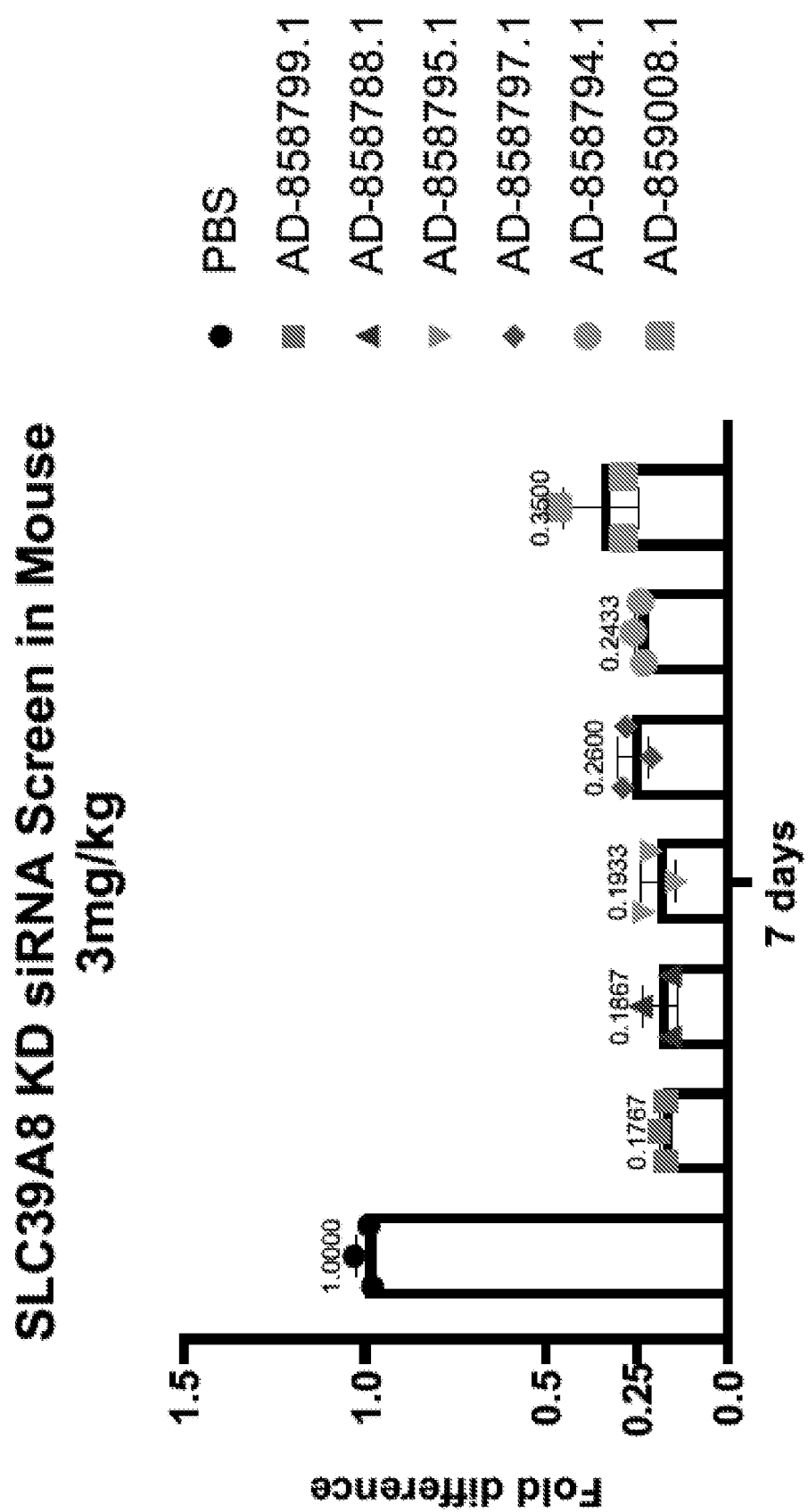
FIG. 2 is a graph showing SLC39A8 mRNA levels in mice (n=3 per group) subcutaneously administered a single 3 mg/kg dose of the indicated dsRNA duplexes at 7 days post-dose. SLC39A8 levels are shown relative to control levels detected with PBS treatment.

SLC39A8 mRNA levels were compared to a housekeeping gene, GAPDH. The values were then normalized to the average of PBS vehicle control group. The data were expressed as percent of baseline value, and presented as mean plus standard deviation. The results, shown in FIG. 2, demonstrate that the exemplary duplex agents tested effectively reduce the level of the SLC39A8 messenger RNA in vivo.

In a second set of analyses, C57BL/6 mice were subcutaneously administered a single 5 mg/kg or 10 mg/kg dose of dose of AD-858799; AD-858788; AD-858795; or AD-858794.1, or PBS control. At day 21 (n=3) or day 28 (n=3) post-dose, animals were sacrificed, liver samples were collected and snap-frozen in liquid nitrogen. Liver mRNA was extracted and analyzed by the RT-QPCR method.

Figure 3:
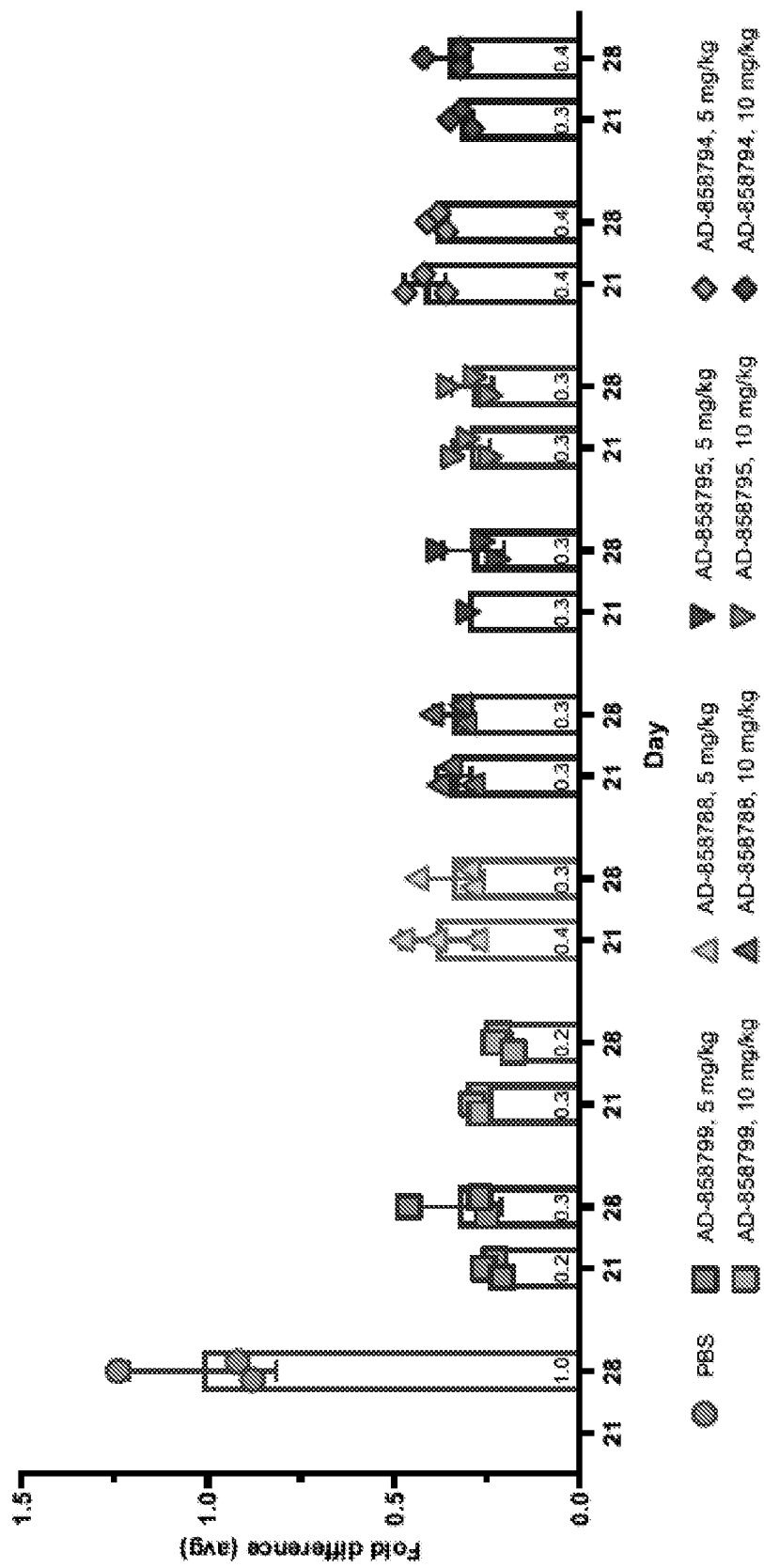
FIG. 3 is a graph showing SLC39A8 mRNA levels in mice (n=3 per group) subcutaneously administered a single 5 mg/kg or 10 mg/kg dose of the indicated dsRNA duplexes at 21 or 28 days post-dose. SLC39A8 levels are shown relative to control levels detected with PBS treatment.

SLC39A8 mRNA levels were compared to a housekeeping gene, GAPDH. The values were then normalized to the average of PBS vehicle control group. The data were expressed as percent of baseline value, and presented as mean plus standard deviation. The results, shown in FIG. 3, demonstrate that the exemplary duplex agents tested effectively and durably reduce the level of the SLC39A8 messenger RNA in vivo.

EQUIVALENTS

Those skilled in the art will recognize, or be able to ascertain using no more than routine experimentation, many equivalents to the specific embodiments and methods described herein. Such equivalents are intended to be encompassed by the scope of the following claims.

SEQUENCE LISTING (1934 sequences)

SEQ ID NO: 1 - DNA, 2869 bp, Homo sapiens
actgcccccgccactcctttagactctggacgtgcggggactggtggcgctcggcctcgcgttataaaaagcggtggggcagggccggcgagacaatctgggaggcgggtaccgggcctcacggatccgcgccgcgccccccacctgtggctgcgcgcggggtgggctgcgctcccctgggcggcgccgggcgcccggggctggtggcgagatgggccgctactctggcaagacgtgccggctgctcttcatgctggtgctcaccgtcgccttcttcgtggcggagctggtctccggctacctgggcaactccatcgcgctgctctccgactccttcaacatgctctccgacctgatctcgctgtgcgtgggcctgagcgccggctacatcgcccggcgccccacccggggcttcagcgccacctacggctacgcccgcgccgaggtggtgggcgcgctgagcaacgcggtcttcctcaccgcgctctgcttcaccatcttcgtggaggccgtgctgcgcctggcccggcccgagcgcatcgatgaccccgagctggtgctcatcgtcggcgtcctggggctgttggtcaacgtggtggggctgctcatcttccaggactgcgccgcctggttcgcgtgctgcctccggggacgcagtcgccgcctgcagcagcggcagcagctggcggagggctgtgtccccggcgctttcggggggcctcagggcgcggaggacccgcggcgcgcggcggacccgacagccccaggctcggactcggccgtaaccctccgggggacctcggtggaaaggaagcgggagaagggggcgaccgtgttcgcaaacgtagcaggtgattccttcaacacccagaatgagccagaagacatgatgaaaaaagagaaaaagtctgaagctctgaatatcagaggtgtacttttgcatgtgatgggagatgccctggggtccgtggttgtggtcatcacggccatcatattctatgtgcttcccctgaagagtgaggacccgtgtaactggcagtgttacattgaccccagcctgactgtcctcatggtcatcatcattttgtcatctgccttcccgcttatcaaggagaccgctgccattctgctacagatggtcccaaaaggagtcaacatggaagagctgatgagtaaactctctgctgtgcctggaattagcagtgtacatgaagtgcacatctgggaacttgtaagtggaaagattattgccaccctgcacatcaagtatcctaaggacaggggatatcaagatgccagcacaaaaattcgagaaatcttccaccatgcgggaatccacaatgtgaccatccagtttgaaaatgtggacttgaaggaacccctggagcagaaggacttactgttgctctgcaactcaccctgcatctccaagggctgtgctaagcagctgtgttgtccccccggggcactgcctctggctcacgtcaatggctgtgctgagcacaatggtgggccctctctagacacatacggaagtgatggcctcagtagaagagacgcaagagaagtggctattgaagtgtctttggatagctgtctgagtgaccacggacaaagtcttaacaaaactcaggaggaccaatgttatgtcaacagaacgcatttttaatctggtactcacataatcagaccatatagacgaggcactttggaaccacaagcttggctcacaaaaagagctttctgggttgtaggcccagactagacttgcagcatgcatgctctgtgttcactaggggttggctgtttgggattttagttaaacgtgtctgtgaatttttatgtaactaactcctttccattcccctgggtgtctcatgctgctctttgactgtttcagcttgaacatgcattttctaaagcaaactgcactagtgtatatatcagggacattaaagtctgggactggggctcaatagctgcggatacagtgttcaaagaagttcttgtttctaaactgattagaacttctagctaatgctcaggtgagatcatagcttaaatacattgaaaaaactaaagtaccacaatagctgtatttttcccaatccccttaacgatcataaaagaggcaagttaagtatttctggcactgaagaaatatcttttttctttgattcatttttgaataaatataaaatgaataactattaaggtagaaaatattctcagaacattctagaggaggtaaaggttagtaggagggcgttggccatctctacattttgtgaggtgagagaaaactaatgtttactttctgctgtgaactgaactgcagctatagaatgtttcaaatgcttaaatatataatacatttttttccatggaagtgagggaatatttcagtttcctgaagtatgacacaaatactcatatactgtcttttagagtcagtatagttggagctgttttcatttagtgctttgataatgatttacttatttttccaaatttcgtttgaattttctttcatatgattgcattgatctatgcagcatttaccagaaaagagtattcctgggatagcagaatgcataacactgagtgttaattcttgtgaaataaataagctagactgccttctctttaattagacatattttaaagtatttattatagttgtcaactagtaactcaatgaaaaagttgatgcccaagggagaaatgagaattagcttaattgctgcctttaatgtgtttttgaggaacttaaaattttctttcatgtcgctgatccatattaccaagttcaaataaaatttttataatcggattcagacccataaccaaactaaaaaaaaaaaaaaaa

SEQ ID NO: 2 - DNA, 5836 bp, Mus musculus
aaatcaagcttgggcggcgagggaggaggggcaggggccccgggaggtggcctttgcgactctggggccactcctgcagactctggtcccgcgagcgcgagctggaagcataaaaggtccgggcgggtaagggcgggcctgcagcaggaggtgggctccagaccgccccccccaccccccccgccaacctgttgcggggcgcagcgggctgtagagatgggccgttactcaggcaagacgtgccggctgctgttcatgctggtgctcaccgcggccttcttcgtggccgagctggtgtcgggttacctgggcaactccatcgcgctgctctcggactcgttcaacatgctgtcagacctgatctcgctgtgcgtgggcctgggctccggctacatcgcgcggcgcggtccccgcggctccagtgccacctacggctacgtgcgggccgaggtggtgggcgcgctcagcaacgcagtcttcctcactgcgctctgcttcaccatcttcgtggaggccgtgttgcgccttgcgcggcccgagcgcatcgacgacccggagctggtgcttatcgtgggagccctggggctggcggtcaacgtggtggggctgctcatcttccaggactgcggcgcctgcttctcccgctgcacgcggggtcgccggacccgcccttcgcagcagccaagccagggggatcctcgtggcgctttggggtgtccccaagaggctgcgacagccacagctcctggctcgggcacagcagtgactctccgggggtcctcggccggaagaaagcagcaggagggcgcgaccgtgttctctaatgtagcaggtgattccctgaacaccgagaatgaaccagaagagacgacgaaaaaagagaagaagtctgaagcactcaatatcagaggtgttcttttgcacgtgatgggagatgccttggggtccgtggttgtggtcatcacggctatcatattctatgttcagcccctgagacgtgaagacccgtgtaactggcagtgctacattgaccccagtttgactgttgtcatggtcatcattatcttatcgtcagctttcccactgatcaaagagactgctgtcatcttgctgcagatggtccccaagggggtcaacatggaagagctgatgagccagctgtctaccgtgcctgggattagcagtgtgcatgaagtgcacatctgggaacttataagtgggaagatcattgccaccttgcacatcaaacaccagaagggcacggaataccaggatgccagcagaaaaatccgagagatcttccaccatgctggaatccacaacgtgactatccagttcgaaaccctggacttgaaggaagccctggagcagaaggacttcttgctgacctgcagtgctccctgcatcacccagagctgcgctaagaagctgtgctgtcccccggggacactgcctctggctctcgtcaacggttgtgcagagcacaatggcaggtcctctcgagagtcttaccgaagcatagaagctccagaagtggccatcgatgtggatggctgtccaagggagcagggacagactctcagcaagactcaggagagacaacattatgaaaacagtactcatttttagtgggttcccacacaattcaaaatgtctgaacagacactttggtgtcaccagctctgcttatgggaagagctttgtgggtgtgtatcctgtcagtaggggtcagctgtttgagatgttagtggaacaagcctgctgattttcatgtgatggataacccctttccagtaccctgggcatctcatggttttctgtgacagtttcagtatggacatgaacttcctaaagcagattgccctaatgtatataccaggagtgctgaaggactcagtgactatgacatgggactcgaagtcggtcttgtctgtcttgtggtgctggggaattgcatacagggcttgtgcatgctaaggaactgctctgttaccgagatgaaccctgtagcctttgcttttaaacccatcggaacttctagctgactctcaagcgagctcaaagcttaagtgggtagaaaagaagttaagcaccttatgtttccttctcttcccctcaaagaccataaaaggtgaacgtcagcttatttatagcacttatagaacttatagcattgcagaagtatatattcttaagtccattcttggaccgtgagacatgaacacctaataaatgaatgcaaaatgcatagctattaagatggaaagacagattgcctcttaagacagggagtgctctcaaaacattagagggggtacgctttgctgaggtggagggaaaggtgggttctggactgttgctttgctttgtgaggtggctaaagtttacttcctgctggaactaagctgcggctatgatgtgttccttctccttttcttatttaccaagttatcatctctgaaagtttccaggtaggattgttgccgcatctagttctgataatgattttcttatccagaattcctcacagtcttttatgatcacattgatctgtgcagcattgatcagggggagatgaatcttctgggaatgggagaatactcattcttgctaaacaaataagctagcttgcctttgctttaattaggcatattttaaagtatttattgcagttgccaactagtaactgggtggaaaagttaatttcccagtgagaaatgaaaagtaatttggttgctgactttaatgtgttcagaggctcttagagttttatgtctgtgacccatgttactaagttcaaataaattatgatctgattcaggcacataactgaactgtattgagagaagaaagtgcaaaaaatgtctgtcccgtgtttttataccttgtttggcatccatgtttaaatcaaagcctcagaggtatgacatgggggtacctgatggagccaacatcttgttagacaagtttcaaggctcactgaaagtggtcttgtcgtaggctttgatccttctgagaaactacataggattcatcagaagtggtgcacggtcacagaaaaggcagccacacttgtcaatgtaagcatcattttaaagaaaatgccttcattgggcaccatggcgcatgcctatagtcccggctactcaggaggctgagacagaagagttgcttgagcctaggagttcaaaaccagcccaggcaaaatggtgcgactcagggtgttttgttttgtgtttttaatattagtcttaaatttggaggctgatgggcagctgtgatctgggttattgggaaatctttgttccttagaagttgattagatctaaaccaaccacccataagtaaatagaaaaatatctaaagcctttctaattcccagaagtttattgtgttagattatgtatgcactttataagccagaggaggaaaaaagacaaagtttctactttaggcaccaaacctgtgaagtagacttacagggaccagaggattccccaggaagcccagcgtggggatgtgcatgcagatgccgctgctgtgccaactctgttccatgccttagttgaagccaaagtagaaatttgtctctaatgtccaaatctcaattcactgtgccttattcttaaaggaaaagaatgataattttacagtttctcctactagctagaggaatgtattttagtttgcatgtaaataacatcctttaatttctgaagtacttttttttttatggaaagaaagtacacttagttccaacataattaaatttaaccttgattgacactcaactagcaaattatagacaggagccagtatgaagacagccagagcatgtttactaattggacattagttgaaagggttcgatgcttttgctacatggctgtgtttaacacctccaccctggctgcctggtgtttttgtctggggtttcctgcatccgtgattgtcttgatttttaattctctgaagaagagcttgatgttttcccctccctggatcagctgtgcacctggtggacaagacgatctcgtttctttgagcctgtgtaaacactgaccttcagttcacgccctgcatgctcaggttcatcctagagcccctcccaccttcctccttcctgcctgtcctccacatttcccctggaaggggtggtgctcaggcccaggtccttcaaggctgtgaggcacgttttactgatgagctacaatccccaaccccaaagactaattttctatagtctgtgtcacaccctgtatgggacaggttagtattaggtgtcctgcgtgccatccttctaggatttttcgtgctttcctgtatttgtttctctgtggagcacagcacttccttccagcgcgtcagcaccagttgtaggaaagaattgcttcccttcccttcacatcttccaatcggagtttttaaaactgggatatttcttgacaatttggttattatgaacacacacagggataccaatctccattacacacacacacacacacacacacacacacacacacacacactgcaaattaggaacttcaagattcaatggagtgggtgttagggagtttccatcttgatacgttggcattctgagctaggtgtgtccaggtcatattatgtattatttagtagcattgttgatttctagtcacaactcccaaatcatcttcccaagctatgacaaccaaaagttcctctagacattgtcatgtattccctggggggggggggagggcactaccaacccttctctatttctaaacctcgagctataatcatatttaagcattattgatggatctgctcctcccaagtccaatagtgtactctattctgcaggattcatagcctccccccacccccagcctggaactctctgtcctgcagccccagcctcctgagttcaggttttataggcatccgtcaccatacttacatcaggatttactgtttacgagcagtattttaacaggactttcatttgctgtgctgaggcttgaagccacccttgctacagggacacgcacttggagggaagctcttagtaacctgaggcagccactgatcacatagtaagcttgagactagcctttctacgtgagacttgagttaggttgcactttgtatttgggttttgaatctggttagcaatcactgacgtgtgccttctctagagctctgtcattgccttatgtcctgtcaccctttgtgcttcagagtgtatttccactcaagtgaccatgagtgggaacaaggtggtcaaaccgggaaagcagtttcttaagcagaacctgtatcggatccaaatcttcagtgtagaaaatgttcttagcatctggaaaatatatgttgttttctggcatttcctctctttctaactaccctaccctgacccaagactttctatttacatggacttttcttagttaggtgggactggcgccttcatgccagagtcgctgaatggcctctgaactggagtgagcactatccagaaagggttgacacgggagagccatcctttcctggaggcttgaggttatgttacagtaattgtggagttttgttgctttaaaatcctccttctcttctcaagggcaagattgccaaagtgtagcatcgcatttggggtgggggttgttaaaacttctgagtttcaataacttcttgctcgttgcatgggaaccaaccccctccccatggatgtgcacgtgcacacctgttgctggtgaagagcattcaatggtgctgtaaatgacgtgttttgaaaactagaaatgccaatcagatgttcgtggaaattaaacagacagctcaaagcaaa

SEQ ID NO: 3 - DNA, 2243 bp, Rattus norvegicus
aaatcaggcttgggcggcgagggaggaggggcaggggccccgggaggtgccctttgcgactctggggccactcctgcagactctggtcccgcgagcgcgagctagtggcataaaaggcccgggagggtaagggcgggcctgccgccggaggtgggctccagacccccgcaacctgttgcggggctcagcgggctgtaaagatgggccgttattcgggcaagacctgtcggctgctgttcatgctggtgctcaccgcggccttcttcgtggccgaactggtgtcgggttacctgggcaactccatcgcgctgctctcggactcgttcaacatgctgtctgatctgatctcgctgtgcgtgggcctgggctccggctacatcgcgcgacgcggtccccgcggctccagcgccacctacggctatgtgcgggcggaggtggtgggcgcgctcagcaacgcagtcttcctcaccgcgctctgctttaccatcttcgtggaggccgtgttgcggctcgcgcggcccgagcgcatcgacgacccggagctggtactcatcgtgggcgccctggggctggcagtcaacgtggtggggctgctcatcttccaggactgcggcgcctgcttctcccgctgcacgcggggtcaccggacccgcccttcgcagccgccgcgccagggggacactggtggcgctttggggtgtccccgggaggctgcgacagccacagaccccggctcagactcagcagtgactctccggggggcctcggccggaagaaagcagcaggagggcgcgacggtgttctcgaatgtagcaggtgattccctgaacacccagaatgaaccagaagagacaacaaaaaaggagaagaagtctgaagcactgaatatcagaggtgttcttttgcatgtgatgggagatgccctggggtccgtgattgtggttgtcacagccatcatattctatgttcgtcccctgagacatgaagacccgtgtaactggcaatgctacattgaccccagtttgactgttgtcatggtcatcattatcttatcatcagcctttccactcatcaaggagactgctgtcatcctgctgcagatggttcccaagggagtcaacatggaggagctgatgagccagctgtctatggtgcctggggttagcagtgtgcatgaagtgcacatctgggaactgataagtgggaaggttattgccaccttgcacatcaagcaccaggagggcacggaataccaggatgccagcagaaaagtccgcgagatcttccaccatgcaggaatccacaacgtgaccatccagtttgaaacattggacttgaaggaagccctggagcagaaggacttcttgccaacctgcagtgcaccctgcatctcccagagttgcgctaagaagctctgctgtcccccggggacactgcctctggctctcgtcaatggttgtgcagagcacaatggtgggcccaatctagagtcttaccgaagcatagaagctccagaagtggtcatagatgtggctttggatggctgtccaaggaagcaaggacaggttcacagcaagactcaagagagacagcattgtgaaaacagcactcatttttagtgggttcccacacaaatcaaacagtctaaacagacactttggtgtcactggctctgcttgtgggaagagctctgtggatgtgtatcctgtcagtaggggtcagccatttgagatgttagtggaacaagcctgctgattttcatgtggtggataacccctttccagtactctgggcatctcatggttctctgtgacagtttcagtacggatatgaatttcctaaagcagactgccctagtgtatatatcaggagtgttgaagggctcagcaactatgacaggggacatgaagtaggtcttgtctgtcttgtggtgctggggaattgcatacagggctcgtgcgtgctaaggaactgctctgttaccgagatgaactctgtatgtagcctttgttttcaaacacatcagaacttctagttgactctcaggtgagctcaaagcttacgtgggtagaaaagcagttaagcaccttaactatgttttcctctcttcccctcaaagatcataaaagatgaacatcaggttttcgtggccctgcagaaacatatattcttaagtccattcttggaccacgagaaacagacacctaataaataaattcaagatgcatagttattaagatgga

SEQ ID NO: 4 - DNA, 5183 bp, Macaca mulatta
ggccgctaccactcctttagactctggacgtgcggggactggcggcgctcagcctcgcgttataaaaagcggccggacagtatcggcaagacaatctgggaggcgggtaccggacctcacgtatccgcgccgcgccccccacctgtggctacgcgcggggctggctgcgctcccctgggcggcgccgggcgcccgcggctggtggcgagatgggccgctactcgggcaagacttgccggctgctcttcatgctggtgctcaccgtcgccttcttcgtggcggagctggtctccggctacctgggcaactccatcgcgctgctctccgactccttcaacatgctctccgacctgatctcgctgtgcgtgggcctgagcgccggctacatcgcccggcgccccaccgggggcttcagcgccacttacggctacgcccgcgccgaggtggtgggcgcgctgagcaacgccgtcttcctcaccgcgctctgcttcaccatcttcgtggaggccgtgctgcgcctggcccggcccgagcgcatcgatgaccccaagctggtgctcatcgttggcgtcctggggctgttggtcaacgtggtggggctgctcatcttccaggactgcgctgcctggttcgcgtgctgccgccggggccgccgtcgccgcctgcaacagcggcagcagctggcggaggactacgtccccagcgctttcggggggcctcagggtgcagaggacccgcggcgcgctgcggccccgacagccccaggctcggactcggccgtaaccctgcgggggacctcggtggaaaggaagcgagagaagggggcgaccgtgttctcaaacgtagcaggtgattccttcaacacccagaatgagccagaagaggtgatgaaaaaagagaaaaagtctgaagctctgaatatcagaggtgtacttttgcatgtgatgggagatgccctggggtccgtggttgtggtcatcacggccatcatattctatgtgcttcccctgaagagtgaggacccgtgtaactggcagtgttacattgaccccagcctgactgtcctcatggtcatcatcattttgtcatctgccttcccgctcatcaaggagaccgctgccattctgttgcagatggtccccaaaggagtcaacatggaagagctgatgagcaaactctctgctgtgcccggaattagcagtgtacatgaagtgcacatctgggaacttgtaagtggaaagattattgccaccctgcacatcaagtatcctaaggacaggggatatcaagatgccagcacaaaaattcgagaaatcttccacagtgcaggaatccacaatgtgaccatccagtttgaaaatgtggacttgaaggaacccctggagcagaaggacttactgttgctctgcaactcaccctgcatctccaagagctgtgctaagcagctgtgttgtccccccggggcactgcctctggcccacgtcaatggctgcgctgagcacaatggcgggccctctctagacacatacggaagtgatggcctcagtagaagagacacaagagaagtggctattgaagtgtctttggacggctgtctgagtgaccacggacaaactcttaacaaaactcaggaggaccaatgttatgtcaacagcactcatttttaatctggtacccacataaccagaccgtatagtcgaggcactttggaaccaccatcttggctcataaaaagagctttccgggttgtaggctcagaccagacttgcagcgtgcatgctctgtgttcactaggggttggctgttagggattttagttaaacgtgtctgtgaatttttatgtaacccctttccattcccctgggtgtctcatgctgctctttgtttcagcttgaacatgcattttctaaagcaaactgcactagtgtatatatcagggacactgaagtctgggactggggctcaatagctgtggatacagtgttcaaagaagttcttgtttctaaactgattagaacttctagctaatgctcaggtgagatcatagcttaaatacattcaaaaaactaaagtaccacaataagtgtatttttccctttccccttaatgatcataaaagagacaagttaagtatttctgacactgaagaagtatcttttttctttgattcatttttggataaatataaaatgaataactattacggtagaaaatattctcagaacattctagaggaggtaaagattagtaggggggttttggccatctctacatttttgtgaggtgagagaaaactaatgtttactttctgctgtgaaatgaattgtggctatagaatgtttcaaatgcttaaatatataatacatgtttttcacatggaagtgagggaatatttcagctttcttaagtatgacacaaatactcagctgtcttttagagtcagtatagttggagctgtttccatttagtgctttggtaatgatttacttattcttccaaacatcctttgacttttctttcatacgattgcattgatctatgcagcatttaccagaaaaaaagcattcctgggatagcagaatccttaacattgagtgttaattcttgtgaaataaataagctagactgccttctctttaattagacatattttaaaatatttattatagttgtcaactagtaactcagtggaaaagttgatgtccaaggaagaaatgagaattagcttagttgctgcctttaatgtgtttttgagaaacttaaaattttctttcatgtctctgatccatattagcaagttcaaataaaatttttgtaatcggattcagacccataaccaaagaatattggcagtagagaagcatctgtcatgtatttaacacattgttcagcatcagtatttaaatcagaacagtctcgcaggtatgagaaaatgggaggtgcatcactagacaactagtatcatctttgctagactgcaagactgtatgaaaataaccgtctcttagtgtgtaaagtcctgtttaaaatctgcacaggatttatcagaggtgctgggttgataatgaaggcagcatccacaattttttagaacaaacatcatatttaaacaatttatcttagtcctgaatttgaaggctaaaacaaataagcagctctgatcagtaggctaggaaatcattattttttcttttttgtaaaaacagggtctcgctgtgttgcccaggctggctttgaattcctagcctcaagtgattctcccacctcggcctcccaaagcacagggagaacaggcatgagccactgcgcctggacaggaaattctttgttccctgaaaatgtattatctgagtttaaattggctgtgaattaggtaaatagaaaaacgcctaaaaatgtttttatttctgggagcttattgggctaggctacatgcactttataagcataaaggggttaataagtaagaatttccatttttagtgttaaaagtgtggcatgcactcacacaaaacagtggatcctctaagaaactcagcatggagataagtgggccagattctcctacataaacattggttgaaattccttagagccaaaaagaaatttttctctgacttcctaatctgaaggtctaatttgatttcacatcattctgcctttattaaaaggtaaaattataatttcacagtttttgtgcaactggctgaaggaatgcatattagtttgcatttaaacactgttctttaatctctaaaatatttttctgggtaagaaaaggcacttaattccactataattaaacctaacttcagaaaagtatcttgatagacagttatgccagattatggtctggagtcaatgtgaaataatacctttttaaggacagtttggctgagtgcatttaagaatgtccaatcatgctaagtgcaataattttgtattgggttgggtggcttgcatttgccacctgtggcactgtgatgcctgctgtatgctattttcacttgagtttaactctctctttaattgtcctgctttttaattctcccaaggaaatacaagagttttctttttccctttaaatcaaccctgcttggtggcaatagcagctgataaatagattcaaaacagcactgttttcctttaagattagaaaaacactggcactcagtttggtgctcctgtatacttatttacagaaatccccccaccccaccccacctttttattttttaaagaactgacgtaattttcaaagtctatggcatattttgtgtgtcaggtcagggaccagttgtcctgtgtgctaacctggccttctatgtggccctactgcacttctgtttctatagaaacagtcctttccacattattgtagcattggccataggaaatactatatctgcttcattttctgactctcaacattgtttttgaaaatataattttttttaacatgatattgggccattatgaatatccacagacaggatccattgttgacagaaaataaaattactctctaacttcttgataaaatatcaataaaatacagagacattatttgaggaagaattaagaatattctccatatttagttccttttttttttttttttttttttgccatcggtagagcaaattccagtggtggtaaatcaagaactctaaagttcagtaggaataggtgttttgaatgtcaaggaaatcactgaggtagatttgagatgacaataagacagctgccctgtgaggtcataagagcttttgtgaggcttactccgggggttctcagtcttggcattattgacattttgaattggatgtgttcttgctcctgatgtgtggatgtgtattgtaggatgtttagcagcacgcctgacctctattcataaatgccagtactgtccccccaagttgtgacaaccaatgtctccagacattgtcacatataacctgggggaaaaaattgcccccaattctgagccactgggtagaactaagggtagtttagggacaatgttgatgaaagcctctccgaagtcccatagtctttttaataatgaattctgcagaatttgctctttaaaaacatatttttaaaggcaagacccgtctattcataaaagttgcagttgtttccacacaggaactttggacatttaaagaaaaatgtaattt

SEQ ID NO: 5 - DNA, 3138 bp, Macaca fascicularis
ccctgggcggcgccgggcgcccgcggctggtggcgagatgggccgctactcgggcaagacttgccggctgctcttcatgctggtgctcaccgtcgccttcttcgtggcggagctggtctccggctacctgggcaactccatcgcgctgctctccgactccttcaacatgctctccgacctgatctcgctgtgcgtgggcctgagcgccggctacatcgcccggcgccccaccgggggcttcagcgccacttacggctacgcccgcgccgaggtggtgggcgcgctgagcaacgccgtcttcctcaccgcgctctgcttcaccatcttcgtggaggccgtgctgcgcctggcccggcccgagcgcatcgatgaccccaagctggtgctcatcgttggcgtcctggggctgttggtcaacgtggtggggctgctcatcttccaggactgcgctgcctggttcgcgtgctgccgccggggccgccgtcgccgcctgcaacagcggcagcagctggcggaggactacgtccccagcgctttcggggggcctcagggtgcagaagacccgcggcgcgctgcggccccgacagccccaggctcggactcggccgtaaccctgcgggggacctcggtggaaaggaagcgagagaagggggcgaccgtgttctcaaacgtagcaggtgattccttcaacacccagaatgagccagaagaggtgatgaaaaaagagaaaaagtctgaagctctgaatatcagaggtgtacttttgcatgtgatgggagatgccctggggtccgtggttgtggtcatcacggccatcatattctatgtgcttcccctgaagagtgaggacccgtgtaactggcagtgttacattgaccccagcctgactgtcctcatggtcatcatcattttgtcatctgccttcccgctcatcaaggagaccgctgccattctgttgcagatggtccccaaaggagtcaacatggaagagctgaccactggattctcttcagtatttggccttgacacatcacaacacggaaggagaaaagcaaactggagaaaaggtgaagtggtttcttgaagcagtaacgtatggtggaagacagaggccgaagctcagttgatcccagggaatgagtcctacagagctgagattattgattgctattgaaatgtggggtgcctattcgttgtcacccttatctaaaagttgttcattagaattcataattgccttgtcataaaagagggcttgcattttgaactgctgggcaagcgaaaactctggactttttaatgtttttgaacagcctacttcttatgaaagcaaccacacctcatggagatctcatcaggtctctggaaagcaagtcatgcacttagaggcaggtcatgcagcagagtcgtgatcttccctctttctccacggtgctcttctctatgagagctctgagtaccttagatatacagtaaatctgtccttaactacaagttcttactccgctgaattctaacataagaagatttgcttctgtataccttttcaatatctaggagaatttggattctagaatatgtaaattgcttgtcaactcctgtgagggtaatttggaagaacaggaagctacgtatctggaatagtgacaaggatatcgttgacagagcagaattaaagccctttgcatggacgtcttaggaaagataaaatcaaatgagggaaatgaaaccttggccttggtactgcatgtgcgtgagaagagccaggagtaggcaaggtcagggactttggaatgcagagacaaggagaggggctaaggggataaaggctagatgtgtggcctggggtgagactgaatggtgagtcctggaagtcaggggttaacatagccatgtgtcaaccttggaaaagcattcaacatttggctcataaaaaaaaagtgcattgcagtatgaggactgtctgtttaagaaaacaattcgaaatggaccaacaaacttattttcaaaattaaggagatcatggaccttttctagcaagcaagtgatgatagcatgaaaaaataaagcacctttattacttatttacaatatataactattattactgttgcttatattttgcactttctctgcaggtttattttagtggatgtataatatttactaggcctttcattctcacctttgccttcaattgaaatttcataaataagattttaagtcctcttctactcccacagtgaaacgttctcctttcggggaacttttagatacccaacagcagtgtttagggagagcgttctgttttatgaatgactagtaataacatcaaaaggatgcaaaaacaacaacaaaaaataggcatgggtacaaaagaataaccaaaaatgcttatctgccatatcaacttcatttaaagacattttgagaatgcagcccctcacttaaatgaaaaggtagtttgcactgagctgaaacatttaactataacaaaatttgttgttgggctacttagatccccattctcaattcccttttctcctgcctgcctccactgtaaaggctggaaatgccacctgcttactgtcccagcctcacctgcagttcgggattcccatatggcagttttggctgatggtgagaatgcaggagtttttaggtttgggaaagaaagagtgctgggaaggctttcatttttttcttcacaaaaagaagagatagaactttcatttccctttctctcttctttttcacttgaatgcagattagatgcacagagctatgataaccatcttgtgaccaaaagaaagaaaaagacacacacacacacacacacacacagaagaaattaatcacaggaatgcaggttgtgatgttgctgggctgtgtaaccacagtcagcagctgctgatctctaggcttcttttcacaggagaagagtaaacttgtagtcttttaaatacattgttagaaaacctcctgttacttgaagctagaagcattcctaactgatccacagtactgtaattttcttatttcctcattggcaaacatgagtctgttcatggaatcgtattagcaattgatagtgcctatggggagtgtatattgttccagccttgtctttaattctta

SEQ ID NO: 6 - DNA, 2869 bp, Homo sapiens
ttttttttttttttttagtttggttatgggtctgaatccgattataaaaattttatttgaacttggtaatatggatcagcgacatgaaagaaaattttaagttcctcaaaaacacattaaaggcagcaattaagctaattctcatttctcccttgggcatcaactttttcattgagttactagttgacaactataataaatactttaaaatatgtctaattaaagagaaggcagtctagcttatttatttcacaagaattaacactcagtgttatgcattctgctatcccaggaatactcttttctggtaaatgctgcatagatcaatgcaatcatatgaaagaaaattcaaacgaaatttggaaaaataagtaaatcattatcaaagcactaaatgaaaacagctccaactatactgactctaaaagacagtatatgagtatttgtgtcatacttcaggaaactgaaatattccctcacttccatggaaaaaaatgtattatatatttaagcatttgaaacattctatagctgcagttcagttcacagcagaaagtaaacattagttttctctcacctcacaaaatgtagagatggccaacgccctcctactaacctttacctcctctagaatgttctgagaatattttctaccttaatagttattcattttatatttattcaaaaatgaatcaaagaaaaaagatatttcttcagtgccagaaatacttaacttgcctcttttatgatcgttaaggggattgggaaaaatacagctattgtggtactttagttttttcaatgtatttaagctatgatctcacctgagcattagctagaagttctaatcagtttagaaacaagaacttctttgaacactgtatccgcagctattgagccccagtcccagactttaatgtccctgatatatacactagtgcagtttgctttagaaaatgcatgttcaagctgaaacagtcaaagagcagcatgagacacccaggggaatggaaaggagttagttacataaaaattcacagacacgtttaactaaaatcccaaacagccaacccctagtgaacacagagcatgcatgctgcaagtctagtctgggcctacaacccagaaagctctttttgtgagccaagcttgtggttccaaagtgcctcgtctatatggtctgattatgtgagtaccagattaaaaatgcgttctgttgacataacattggtcctcctgagttttgttaagactttgtccgtggtcactcagacagctatccaaagacacttcaatagccacttctcttgcgtctcttctactgaggccatcacttccgtatgtgtctagagagggcccaccattgtgctcagcacagccattgacgtgagccagaggcagtgccccggggggacaacacagctgcttagcacagcccttggagatgcagggtgagttgcagagcaacagtaagtccttctgctccaggggttccttcaagtccacattttcaaactggatggtcacattgtggattcccgcatggtggaagatttctcgaatttttgtgctggcatcttgatatcccctgtccttaggatacttgatgtgcagggtggcaataatctttccacttacaagttcccagatgtgcacttcatgtacactgctaattccaggcacagcagagagtttactcatcagctcttccatgttgactccttttgggaccatctgtagcagaatggcagcggtctccttgataagcgggaaggcagatgacaaaatgatgatgaccatgaggacagtcaggctggggtcaatgtaacactgccagttacacgggtcctcactcttcaggggaagcacatagaatatgatggccgtgatgaccacaaccacggaccccagggcatctcccatcacatgcaaaagtacacctctgatattcagagcttcagactttttctcttttttcatcatgtcttctggctcattctgggtgttgaaggaatcacctgctacgtttgcgaacacggtcgcccccttctcccgcttcctttccaccgaggtcccccggagggttacggccgagtccgagcctggggctgtcgggtccgccgcgcgccgcgggtcctccgcgccctgaggccccccgaaagcgccggggacacagccctccgccagctgctgccgctgctgcaggcggcgactgcgtccccggaggcagcacgcgaaccaggcggcgcagtcctggaagatgagcagccccaccacgttgaccaacagccccaggacgccgacgatgagcaccagctcggggtcatcgatgcgctcgggccgggccaggcgcagcacggcctccacgaagatggtgaagcagagcgcggtgaggaagaccgcgttgctcagcgcgcccaccacctcggcgcgggcgtagccgtaggtggcgctgaagccccgggtggggcgccgggcgatgtagccggcgctcaggcccacgcacagcgagatcaggtcggagagcatgttgaaggagtcggagagcagcgcgatggagttgcccaggtagccggagaccagctccgccacgaagaaggcgacggtgagcaccagcatgaagagcagccggcacgtcttgccagagtagcggcccatctcgccaccagccccgggcgcccggcgccgcccaggggagcgcagcccaccccgcgcgcagccacaggtggggggcgcggcgcggatccgtgaggcccggtacccgcctcccagattgtctcgccggccctgccccaccgctttttataacgcgaggccgagcgccaccagtccccgcacgtccagagtctaaaggagtggcgggggcagt

SEQ ID NO: 7 - DNA, 5836 bp, Mus musculus
tttgctttgagctgtctgtttaatttccacgaacatctgattggcatttctagttttcaaaacacgtcatttacagcaccattgaatgctcttcaccagcaacaggtgtgcacgtgcacatccatggggagggggttggttcccatgcaacgagcaagaagttattgaaactcagaagttttaacaacccccaccccaaatgcgatgctacactttggcaatcttgcccttgagaagagaaggaggattttaaagcaacaaaactccacaattactgtaacataacctcaagcctccaggaaaggatggctctcccgtgtcaaccctttctggatagtgctcactccagttcagaggccattcagcgactctggcatgaaggcgccagtcccacctaactaagaaaagtccatgtaaatagaaagtcttgggtcagggtagggtagttagaaagagaggaaatgccagaaaacaacatatattttccagatgctaagaacattttctacactgaagatttggatccgatacaggttctgcttaagaaactgctttcccggtttgaccaccttgttcccactcatggtcacttgagtggaaatacactctgaagcacaaagggtgacaggacataaggcaatgacagagctctagagaaggcacacgtcagtgattgctaaccagattcaaaacccaaatacaaagtgcaacctaactcaagtctcacgtagaaaggctagtctcaagcttactatgtgatcagtggctgcctcaggttactaagagcttccctccaagtgcgtgtccctgtagcaagggtggcttcaagcctcagcacagcaaatgaaagtcctgttaaaatactgctcgtaaacagtaaatcctgatgtaagtatggtgacggatgcctataaaacctgaactcaggaggctggggctgcaggacagagagttccaggctgggggtggggggaggctatgaatcctgcagaatagagtacactattggacttgggaggagcagatccatcaataatgcttaaatatgattatagctcgaggtttagaaatagagaagggttggtagtgccctccccccccccccagggaatacatgacaatgtctagaggaacttttggttgtcatagcttgggaagatgatttgggagttgtgactagaaatcaacaatgctactaaataatacataatatgacctggacacacctagctcagaatgccaacgtatcaagatggaaactccctaacacccactccattgaatcttgaagttcctaatttgcagtgtgtgtgtgtgtgtgtgtgtgtgtgtgtgtgtgtgtgtgtaatggagattggtatccctgtgtgtgttcataataaccaaattgtcaagaaatatcccagttttaaaaactccgattggaagatgtgaagggaagggaagcaattctttcctacaactggtgctgacgcgctggaaggaagtgctgtgctccacagagaaacaaatacaggaaagcacgaaaaatcctagaaggatggcacgcaggacacctaatactaacctgtcccatacagggtgtgacacagactatagaaaattagtctttggggttggggattgtagctcatcagtaaaacgtgcctcacagccttgaaggacctgggcctgagcaccaccccttccaggggaaatgtggaggacaggcaggaaggaggaaggtgggaggggctctaggatgaacctgagcatgcagggcgtgaactgaaggtcagtgtttacacaggctcaaagaaacgagatcgtcttgtccaccaggtgcacagctgatccagggaggggaaaacatcaagctcttcttcagagaattaaaaatcaagacaatcacggatgcaggaaaccccagacaaaaacaccaggcagccagggtggaggtgttaaacacagccatgtagcaaaagcatcgaaccctttcaactaatgtccaattagtaaacatgctctggctgtcttcatactggctcctgtctataatttgctagttgagtgtcaatcaaggttaaatttaattatgttggaactaagtgtactttctttccataaaaaaaaaagtacttcagaaattaaaggatgttatttacatgcaaactaaaatacattcctctagctagtaggagaaactgtaaaattatcattcttttcctttaagaataaggcacagtgaattgagatttggacattagagacaaatttctactttggcttcaactaaggcatggaacagagttggcacagcagcggcatctgcatgcacatccccacgctgggcttcctggggaatcctctggtccctgtaagtctacttcacaggtttggtgcctaaagtagaaactttgtcttttttcctcctctggcttataaagtgcatacataatctaacacaataaacttctgggaattagaaaggctttagatatttttctatttacttatgggtggttggtttagatctaatcaacttctaaggaacaaagatttcccaataacccagatcacagctgcccatcagcctccaaatttaagactaatattaaaaacacaaaacaaaacaccctgagtcgcaccattttgcctgggctggttttgaactcctaggctcaagcaactcttctgtctcagcctcctgagtagccgggactataggcatgcgccatggtgcccaatgaaggcattttctttaaaatgatgcttacattgacaagtgtggctgccttttctgtgaccgtgcaccacttctgatgaatcctatgtagtttctcagaaggatcaaagcctacgacaagaccactttcagtgagccttgaaacttgtctaacaagatgttggctccatcaggtacccccatgtcatacctctgaggctttgatttaaacatggatgccaaacaaggtataaaaacacgggacagacattttttgcactttcttctctcaatacagttcagttatgtgcctgaatcagatcataatttatttgaacttagtaacatgggtcacagacataaaactctaagagcctctgaacacattaaagtcagcaaccaaattacttttcatttctcactgggaaattaacttttccacccagttactagttggcaactgcaataaatactttaaaatatgcctaattaaagcaaaggcaagctagcttatttgtttagcaagaatgagtattctcccattcccagaagattcatctccccctgatcaatgctgcacagatcaatgtgatcataaaagactgtgaggaattctggataagaaaatcattatcagaactagatgcggcaacaatcctacctggaaactttcagagatgataacttggtaaataagaaaaggagaaggaacacatcatagccgcagcttagttccagcaggaagtaaactttagccacctcacaaagcaaagcaacagtccagaacccacctttccctccacctcagcaaagcgtaccccctctaatgttttgagagcactccctgtcttaagaggcaatctgtctttccatcttaatagctatgcattttgcattcatttattaggtgttcatgtctcacggtccaagaatggacttaagaatatatacttctgcaatgctataagttctataagtgctataaataagctgacgttcaccttttatggtctttgaggggaagagaaggaaacataaggtgcttaacttcttttctacccacttaagctttgagctcgcttgagagtcagctagaagttccgatgggtttaaaagcaaaggctacagggttcatctcggtaacagagcagttccttagcatgcacaagccctgtatgcaattccccagcaccacaagacagacaagaccgacttcgagtcccatgtcatagtcactgagtccttcagcactcctggtatatacattagggcaatctgctttaggaagttcatgtccatactgaaactgtcacagaaaaccatgagatgcccagggtactggaaaggggttatccatcacatgaaaatcagcaggcttgttccactaacatctcaaacagctgacccctactgacaggatacacacccacaaagctcttcccataagcagagctggtgacaccaaagtgtctgttcagacattttgaattgtgtgggaacccactaaaaatgagtactgttttcataatgttgtctctcctgagtcttgctgagagtctgtccctgctcccttggacagccatccacatcgatggccacttctggagcttctatgcttcggtaagactctcgagaggacctgccattgtgctctgcacaaccgttgacgagagccagaggcagtgtccccgggggacagcacagcttcttagcgcagctctgggtgatgcagggagcactgcaggtcagcaagaagtccttctgctccagggcttccttcaagtccagggtttcgaactggatagtcacgttgtggattccagcatggtggaagatctctcggatttttctgctggcatcctggtattccgtgcccttctggtgtttgatgtgcaaggtggcaatgatcttcccacttataagttcccagatgtgcacttcatgcacactgctaatcccaggcacggtagacagctggctcatcagctcttccatgttgacccccttggggaccatctgcagcaagatgacagcagtctctttgatcagtgggaaagctgacgataagataatgatgaccatgacaacagtcaaactggggtcaatgtagcactgccagttacacgggtcttcacgtctcaggggctgaacatagaatatgatagccgtgatgaccacaaccacggaccccaaggcatctcccatcacgtgcaaaagaacacctctgatattgagtgcttcagacttcttctcttttttcgtcgtctcttctggttcattctcggtgttcagggaatcacctgctacattagagaacacggtcgcgccctcctgctgctttcttccggccgaggacccccggagagtcactgctgtgcccgagccaggagctgtggctgtcgcagcctcttggggacaccccaaagcgccacgaggatccccctggcttggctgctgcgaagggcgggtccggcgaccccgcgtgcagcgggagaagcaggcgccgcagtcctggaagatgagcagccccaccacgttgaccgccagccccagggctcccacgataagcaccagctccgggtcgtcgatgcgctcgggccgcgcaaggcgcaacacggcctccacgaagatggtgaagcagagcgcagtgaggaagactgcgttgctgagcgcgcccaccacctcggcccgcacgtagccgtaggtggcactggagccgcggggaccgcgccgcgcgatgtagccggagcccaggcccacgcacagcgagatcaggtctgacagcatgttgaacgagtccgagagcagcgcgatggagttgcccaggtaacccgacaccagctcggccacgaagaaggccgcggtgagcaccagcatgaacagcagccggcacgtcttgcctgagtaacggcccatctctacagcccgctgcgccccgcaacaggttggcggggggggtggggggggcggtctggagcccacctcctgctgcaggcccgcccttacccgcccggaccttttatgcttccagctcgcgctcgcgggaccagagtctgcaggagtggccccagagtcgcaaaggccacctcccggggcccctgcccctcctccctcgccgcccaagcttgattt

SEQ ID NO: 8 - DNA, 2243 bp, Rattus norvegicus
tccatcttaataactatgcatcttgaatttatttattaggtgtctgtttctcgtggtccaagaatggacttaagaatatatgtttctgcagggccacgaaaacctgatgttcatcttttatgatctttgaggggaagagaggaaaacatagttaaggtgcttaactgcttttctacccacgtaagctttgagctcacctgagagtcaactagaagttctgatgtgtttgaaaacaaaggctacatacagagttcatctcggtaacagagcagttccttagcacgcacgagccctgtatgcaattccccagcaccacaagacagacaagacctacttcatgtcccctgtcatagttgctgagcccttcaacactcctgatatatacactagggcagtctgctttaggaaattcatatccgtactgaaactgtcacagagaaccatgagatgcccagagtactggaaaggggttatccaccacatgaaaatcagcaggcttgttccactaacatctcaaatggctgacccctactgacaggatacacatccacagagctcttcccacaagcagagccagtgacaccaaagtgtctgtttagactgtttgatttgtgtgggaacccactaaaaatgagtgctgttttcacaatgctgtctctcttgagtcttgctgtgaacctgtccttgcttccttggacagccatccaaagccacatctatgaccacttctggagcttctatgcttcggtaagactctagattgggcccaccattgtgctctgcacaaccattgacgagagccagaggcagtgtccccgggggacagcagagcttcttagcgcaactctgggagatgcagggtgcactgcaggttggcaagaagtccttctgctccagggcttccttcaagtccaatgtttcaaactggatggtcacgttgtggattcctgcatggtggaagatctcgcggacttttctgctggcatcctggtattccgtgccctcctggtgcttgatgtgcaaggtggcaataaccttcccacttatcagttcccagatgtgcacttcatgcacactgctaaccccaggcaccatagacagctggctcatcagctcctccatgttgactcccttgggaaccatctgcagcaggatgacagcagtctccttgatgagtggaaaggctgatgataagataatgatgaccatgacaacagtcaaactggggtcaatgtagcattgccagttacacgggtcttcatgtctcaggggacgaacatagaatatgatggctgtgacaaccacaatcacggaccccagggcatctcccatcacatgcaaaagaacacctctgatattcagtgcttcagacttcttctccttttttgttgtctcttctggttcattctgggtgttcagggaatcacctgctacattcgagaacaccgtcgcgccctcctgctgctttcttccggccgaggccccccggagagtcactgctgagtctgagccggggtctgtggctgtcgcagcctcccggggacaccccaaagcgccaccagtgtccccctggcgcggcggctgcgaagggcgggtccggtgaccccgcgtgcagcgggagaagcaggcgccgcagtcctggaagatgagcagccccaccacgttgactgccagccccagggcgcccacgatgagtaccagctccgggtcgtcgatgcgctcgggccgcgcgagccgcaacacggcctccacgaagatggtaaagcagagcgcggtgaggaagactgcgttgctgagcgcgcccaccacctccgcccgcacatagccgtaggtggcgctggagccgcggggaccgcgtcgcgcgatgtagccggagcccaggcccacgcacagcgagatcagatcagacagcatgttgaacgagtccgagagcagcgcgatggagttgcccaggtaacccgacaccagttcggccacgaagaaggccgcggtgagcaccagcatgaacagcagccgacaggtcttgcccgaataacggcccatctttacagcccgctgagccccgcaacaggttgcgggggtctggagcccacctccggcggcaggcccgcccttaccctcccgggccttttatgccactagctcgcgctcgcgggaccagagtctgcaggagtggccccagagtcgcaaagggcacctcccggggcccctgcccctcctccctcgccgcccaagcctgattt

SEQ ID NO: 9 - DNA, 5183 bp, Macaca mulatta
aaattacatttttctttaaatgtccaaagttcctgtgtggaaacaactgcaacttttatgaatagacgggtcttgcctttaaaaatatgtttttaaagagcaaattctgcagaattcattattaaaaagactatgggacttcggagaggctttcatcaacattgtccctaaactacccttagttctacccagtggctcagaattgggggcaattttttcccccaggttatatgtgacaatgtctggagacattggttgtcacaacttggggggacagtactggcatttatgaatagaggtcaggcgtgctgctaaacatcctacaatacacatccacacatcaggagcaagaacacatccaattcaaaatgtcaataatgccaagactgagaacccccggagtaagcctcacaaaagctcttatgacctcacagggcagctgtcttattgtcatctcaaatctacctcagtgatttccttgacattcaaaacacctattcctactgaactttagagttcttgatttaccaccactggaatttgctctaccgatggcaaaaaaaaaaaaaaaaaaaaaaggaactaaatatggagaatattcttaattcttcctcaaataatgtctctgtattttattgatattttatcaagaagttagagagtaattttattttctgtcaacaatggatcctgtctgtggatattcataatggcccaatatcatgttaaaaaaaattatattttcaaaaacaatgttgagagtcagaaaatgaagcagatatagtatttcctatggccaatgctacaataatgtggaaaggactgtttctatagaaacagaagtgcagtagggccacatagaaggccaggttagcacacaggacaactggtccctgacctgacacacaaaatatgccatagactttgaaaattacgtcagttctttaaaaaataaaaaggtggggtggggtggggggatttctgtaaataagtatacaggagcaccaaactgagtgccagtgtttttctaatcttaaaggaaaacagtgctgttttgaatctatttatcagctgctattgccaccaagcagggttgatttaaagggaaaaagaaaactcttgtatttccttgggagaattaaaaagcaggacaattaaagagagagttaaactcaagtgaaaatagcatacagcaggcatcacagtgccacaggtggcaaatgcaagccacccaacccaatacaaaattattgcacttagcatgattggacattcttaaatgcactcagccaaactgtccttaaaaaggtattatttcacattgactccagaccataatctggcataactgtctatcaagatacttttctgaagttaggtttaattatagtggaattaagtgccttttcttacccagaaaaatattttagagattaaagaacagtgtttaaatgcaaactaatatgcattccttcagccagttgcacaaaaactgtgaaattataattttaccttttaataaaggcagaatgatgtgaaatcaaattagaccttcagattaggaagtcagagaaaaatttctttttggctctaaggaatttcaaccaatgtttatgtaggagaatctggcccacttatctccatgctgagtttcttagaggatccactgttttgtgtgagtgcatgccacacttttaacactaaaaatggaaattcttacttattaacccctttatgcttataaagtgcatgtagcctagcccaataagctcccagaaataaaaacatttttaggcgtttttctatttacctaattcacagccaatttaaactcagataatacattttcagggaacaaagaatttcctgtccaggcgcagtggctcatgcctgttctccctgtgctttgggaggccgaggtgggagaatcacttgaggctaggaattcaaagccagcctgggcaacacagcgagaccctgtttttacaaaaaagaaaaaataatgatttcctagcctactgatcagagctgcttatttgttttagccttcaaattcaggactaagataaattgtttaaatatgatgtttgttctaaaaaattgtggatgctgccttcattatcaacccagcacctctgataaatcctgtgcagattttaaacaggactttacacactaagagacggttattttcatacagtcttgcagtctagcaaagatgatactagttgtctagtgatgcacctcccattttctcatacctgcgagactgttctgatttaaatactgatgctgaacaatgtgttaaatacatgacagatgcttctctactgccaatattctttggttatgggtctgaatccgattacaaaaattttatttgaacttgctaatatggatcagagacatgaaagaaaattttaagtttctcaaaaacacattaaaggcagcaactaagctaattctcatttcttccttggacatcaacttttccactgagttactagttgacaactataataaatattttaaaatatgtctaattaaagagaaggcagtctagcttatttatttcacaagaattaacactcaatgttaaggattctgctatcccaggaatgctttttttctggtaaatgctgcatagatcaatgcaatcgtatgaaagaaaagtcaaaggatgtttggaagaataagtaaatcattaccaaagcactaaatggaaacagctccaactatactgactctaaaagacagctgagtatttgtgtcatacttaagaaagctgaaatattccctcacttccatgtgaaaaacatgtattatatatttaagcatttgaaacattctatagccacaattcatttcacagcagaaagtaaacattagttttctctcacctcacaaaaatgtagagatggccaaaacccccctactaatctttacctcctctagaatgttctgagaatattttctaccgtaatagttattcattttatatttatccaaaaatgaatcaaagaaaaaagatacttcttcagtgtcagaaatacttaacttgtctcttttatgatcattaaggggaaagggaaaaatacacttattgtggtactttagttttttgaatgtatttaagctatgatctcacctgagcattagctagaagttctaatcagtttagaaacaagaacttctttgaacactgtatccacagctattgagccccagtcccagacttcagtgtccctgatatatacactagtgcagtttgctttagaaaatgcatgttcaagctgaaacaaagagcagcatgagacacccaggggaatggaaaggggttacataaaaattcacagacacgtttaactaaaatccctaacagccaacccctagtgaacacagagcatgcacgctgcaagtctggtctgagcctacaacccggaaagctctttttatgagccaagatggtggttccaaagtgcctcgactatacggtctggttatgtgggtaccagattaaaaatgagtgctgttgacataacattggtcctcctgagttttgttaagagtttgtccgtggtcactcagacagccgtccaaagacacttcaatagccacttctcttgtgtctcttctactgaggccatcacttccgtatgtgtctagagagggcccgccattgtgctcagcgcagccattgacgtgggccagaggcagtgccccggggggacaacacagctgcttagcacagctcttggagatgcagggtgagttgcagagcaacagtaagtccttctgctccaggggttccttcaagtccacattttcaaactggatggtcacattgtggattcctgcactgtggaagatttctcgaatttttgtgctggcatcttgatatcccctgtccttaggatacttgatgtgcagggtggcaataatctttccacttacaagttcccagatgtgcacttcatgtacactgctaattccgggcacagcagagagtttgctcatcagctcttccatgttgactcctttggggaccatctgcaacagaatggcagcggtctccttgatgagcgggaaggcagatgacaaaatgatgatgaccatgaggacagtcaggctggggtcaatgtaacactgccagttacacgggtcctcactcttcaggggaagcacatagaatatgatggccgtgatgaccacaaccacggaccccagggcatctcccatcacatgcaaaagtacacctctgatattcagagcttcagactttttctcttttttcatcacctcttctggctcattctgggtgttgaaggaatcacctgctacgtttgagaacacggtcgcccccttctctcgcttcctttccaccgaggtcccccgcagggttacggccgagtccgagcctggggctgtcggggccgcagcgcgccgcgggtcctctgcaccctgaggccccccgaaagcgctggggacgtagtcctccgccagctgctgccgctgttgcaggcggcgacggcggccccggcggcagcacgcgaaccaggcagcgcagtcctggaagatgagcagccccaccacgttgaccaacagccccaggacgccaacgatgagcaccagcttggggtcatcgatgcgctcgggccgggccaggcgcagcacggcctccacgaagatggtgaagcagagcgcggtgaggaagacggcgttgctcagcgcgcccaccacctcggcgcgggcgtagccgtaagtggcgctgaagcccccggtggggcgccgggcgatgtagccggcgctcaggcccacgcacagcgagatcaggtcggagagcatgttgaaggagtcggagagcagcgcgatggagttgcccaggtagccggagaccagctccgccacgaagaaggcgacggtgagcaccagcatgaagagcagccggcaagtcttgcccgagtagcggcccatctcgccaccagccgcgggcgcccggcgccgcccaggggagcgcagccagccccgcgcgtagccacaggtggggggcgcggcgcggatacgtgaggtccggtacccgcctcccagattgtcttgccgatactgtccggccgctttttataacgcgaggctgagcgccgccagtccccgcacgtccagagtctaaaggagtggtagcggcc

SEQ ID NO: 10 - DNA, 3138 bp, Macaca fascicularis
taagaattaaagacaaggctggaacaatatacactccccataggcactatcaattgctaatacgattccatgaacagactcatgtttgccaatgaggaaataagaaaattacagtactgtggatcagttaggaatgcttctagcttcaagtaacaggaggttttctaacaatgtatttaaaagactacaagtttactcttctcctgtgaaaagaagcctagagatcagcagctgctgactgtggttacacagcccagcaacatcacaacctgcattcctgtgattaatttcttctgtgtgtgtgtgtgtgtgtgtgtgtctttttctttcttttggtcacaagatggttatcatagctctgtgcatctaatctgcattcaagtgaaaaagaagagagaaagggaaatgaaagttctatctcttctttttgtgaagaaaaaaatgaaagccttcccagcactctttctttcccaaacctaaaaactcctgcattctcaccatcagccaaaactgccatatgggaatcccgaactgcaggtgaggctgggacagtaagcaggtggcatttccagcctttacagtggaggcaggcaggagaaaagggaattgagaatggggatctaagtagcccaacaacaaattttgttatagttaaatgtttcagctcagtgcaaactaccttttcatttaagtgaggggctgcattctcaaaatgtctttaaatgaagttgatatggcagataagcatttttggttattcttttgtacccatgcctattttttgttgttgtttttgcatccttttgatgttattactagtcattcataaaacagaacgctctccctaaacactgctgttgggtatctaaaagttccccgaaaggagaacgtttcactgtgggagtagaagaggacttaaaatcttatttatgaaatttcaattgaaggcaaaggtgagaatgaaaggcctagtaaatattatacatccactaaaataaacctgcagagaaagtgcaaaatataagcaacagtaataatagttatatattgtaaataagtaataaaggtgctttattttttcatgctatcatcacttgcttgctagaaaaggtccatgatctccttaattttgaaaataagtttgttggtccatttcgaattgttttcttaaacagacagtcctcatactgcaatgcactttttttttatgagccaaatgttgaatgcttttccaaggttgacacatggctatgttaacccctgacttccaggactcaccattcagtctcaccccaggccacacatctagcctttatccccttagcccctctccttgtctctgcattccaaagtccctgaccttgcctactcctggctcttctcacgcacatgcagtaccaaggccaaggtttcatttccctcatttgattttatctttcctaagacgtccatgcaaagggctttaattctgctctgtcaacgatatccttgtcactattccagatacgtagcttcctgttcttccaaattaccctcacaggagttgacaagcaatttacatattctagaatccaaattctcctagatattgaaaaggtatacagaagcaaatcttcttatgttagaattcagcggagtaagaacttgtagttaaggacagatttactgtatatctaaggtactcagagctctcatagagaagagcaccgtggagaaagagggaagatcacgactctgctgcatgacctgcctctaagtgcatgacttgctttccagagacctgatgagatctccatgaggtgtggttgctttcataagaagtaggctgttcaaaaacattaaaaagtccagagttttcgcttgcccagcagttcaaaatgcaagccctcttttatgacaaggcaattatgaattctaatgaacaacttttagataagggtgacaacgaataggcaccccacatttcaatagcaatcaataatctcagctctgtaggactcattccctgggatcaactgagcttcggcctctgtcttccaccatacgttactgcttcaagaaaccacttcaccttttctccagtttgcttttctccttccgtgttgtgatgtgtcaaggccaaatactgaagagaatccagtggtcagctcttccatgttgactcctttggggaccatctgcaacagaatggcagcggtctccttgatgagcgggaaggcagatgacaaaatgatgatgaccatgaggacagtcaggctggggtcaatgtaacactgccagttacacgggtcctcactcttcaggggaagcacatagaatatgatggccgtgatgaccacaaccacggaccccagggcatctcccatcacatgcaaaagtacacctctgatattcagagcttcagactttttctcttttttcatcacctcttctggctcattctgggtgttgaaggaatcacctgctacgtttgagaacacggtcgcccccttctctcgcttcctttccaccgaggtcccccgcagggttacggccgagtccgagcctggggctgtcggggccgcagcgcgccgcgggtcttctgcaccctgaggccccccgaaagcgctggggacgtagtcctccgccagctgctgccgctgttgcaggcggcgacggcggccccggcggcagcacgcgaaccaggcagcgcagtcctggaagatgagcagccccaccacgttgaccaacagccccaggacgccaacgatgagcaccagcttggggtcatcgatgcgctcgggccgggccaggcgcagcacggcctccacgaagatggtgaagcagagcgcggtgaggaagacggcgttgctcagcgcgcccaccacctcggcgcgggcgtagccgtaagtggcgctgaagcccccggtggggcgccgggcgatgtagccggcgctcaggcccacgcacagcgagatcaggtcggagagcatgttgaaggagtcggagagcagcgcgatggagttgcccaggtagccggagaccagctccgccacgaagaaggcgacggtgagcaccagcatgaagagcagccggcaagtcttgcccgagtagcggcccatctcgccaccagccgcgggcgcccggcgccgcccaggg

SEQ ID NO: 11 - DNA, 3152 bp, Homo sapiens
gagtttcaccgcggacctgtcagagatacagaggttgtgggggcgggagacagaaagagagagagatccagagaccgagtcttacgttgacacgcagagagaaagacgcagagacagacaaacaaacagataggagaggctctccaggaggccggggggcccactccgcctatcgctcccctcggctacgctgccacttcaatgccccgcaggtcgcgagctgctgttctttcgaaggcgtcggagaaccaggggcgtcccgcgccacctctgactcggagcagcgccgagcactgacgctcccgcccttgggcaaggacgccagtgcgcccgcgcgcgtccctctgcgcggcagcccgtcgcgggccctcaaggggaagcccaggccaggatggccccgggtcgcgcggtggccgggctcctgttgctggcggccgccggcctcggaggagtggcggaggggccagggctagccttcagcgaggatgtgctgagcgtgttcggcgcgaatctgagcctgtcggcggcgcagctccagcacttgctggagcagatgggagccgcctcccgcgtgggcgtcccggagcctggccagctgcacttcaaccagtgtttaactgctgaagagatcttttcccttcatggcttttcaaatgctacccaaataaccagctccaaattctctgtcatctgtccagcagtcttacagcaattgaactttcacccatgtgaggatcggcccaagcacaaaacaagaccaagtcattcagaagtttggggatatggattcctgtcagtgacgattattaatctggcatctctcctcggattgattttgactccactgataaagaaatcttatttcccaaagattttgaccttttttgtggggctggctattgggactcttttttcaaatgcaattttccaacttattccagaggcatttggatttgatcccaaagtcgacagttatgttgagaaggcagttgctgtgtttggtggattttacctacttttcttttttgaaagaatgctaaagatgttattaaagacatatggtcagaatggtcatacccactttggaaatgataactttggtcctcaagaaaaaactcatcaacctaaagcattacctgccatcaatggtgtgacatgctatgcaaatcctgctgtcacagaagctaatggacatatccattttgataatgtcagtgtggtatctctacaggatggaaaaaaagagccaagttcatgtacctgtttgaaggggcccaaactgtcagaaatagggacgattgcctggatgataacgctctgcgatgccctccacaatttcatcgatggcctggcgattggggcttcctgcaccttgtctctccttcagggactcagtacttccatagcaatcctatgtgaggagtttccccacgagttaggagactttgtgatcctactcaatgcagggatgagcactcgacaagccttgctattcaacttcctttctgcatgttcctgctatgttgggctagcttttggcattttggtgggcaacaatttcgctccaaatattatatttgcacttgctggaggcatgttcctctatatttctctggcagatatgtttccagagatgaatgatatgctgagagaaaaggtaactggaagaaaaaccgatttcaccttcttcatgattcagaatgctggaatgttaactggattcacagccattctactcattaccttgtatgcaggagaaatcgaattggagtaatagaaaatggaagatggtgttgttaataaaggcatttaatagataaaaacatctccaaaaaggattttgaagctgatcctatttagttaaaaagataattttgctttcaactgtaggtccagaaaactaattattggcatcagtctgtgaaatagtccattatttgttgttaaaaatgcttcaaaaggttttcagtgtcagtctgagatgcctggtatataggagcctttgggaaatacctatttttcagtattccatgcatattagatatcaccatgaagcaagagacatgcattctataatcatgtagacactcagactcaggggaaaatacaagttatatcctgaaagcctttaaaactctatggtaggatcaaagattcaaatggtttcagagaggttttatttcaattaatttgttctagtgctttcaagagcaagtacatcaaaatgtagaaggtaaaatgtatgcaacactaatataaattattccaagtctttaaggagccaaagaaaaaaaagatttctcacagctttttgttctgttttgtatttcaattaggaacttgcagtattattttgaaaaccattctaaaataataggagttaggaaataaataaagttttgctagccctgctaagttcaggcttagaggcttatcgctaagtataaacttcaccagattccacgaaaagctggatagctttttttctgacttatgttgtggttgcacccctcacaaatggcagaacagtatgtaaagctggtaacacctcggtttcagtgcaccatgtgtttgctttgtgaaggtgaagaatatgttggtttagagaaagaaattggatgtaattttatgcaatttacttttaaagacaaacataactatttagcagagaatattttaataaatgcaaaacaacagctggactgctgtacatcaaggacagattaactggaaaacatatgttccttatgtgtgatcgagagccattcagaaaagacttcctttgtgttcagcctatacttttccatatggtataccttgaaaaaaattagcacaccatggttatttttctaccttttataaaagacagagcctgtttactcatttagaagatagagaaaattggtctaaaattgaacatcctagattcacactcccaagtcacttaaggtgatttgatggtgaggaaaatgattgacaaagcccaacaatgatctcaggaattacattttccaacagaccaaaaaatgttttcatgtagcagcaatgcagatttggtgaatatttaatatatattttagtatgtatttcactttatgactgacaattaaaaaatattgtttggccaaatagtaaacacccttttgaaacca

SEQ ID NO: 12 - DNA, 3492 bp, Mus musculus
ctcagctagcccaccaacttgcgactgatttggtttcctctttctcctctgatttttaagaagtgaggcaaaaaaccaattcctgttcatttttgagacaatgcaaggggctctagacaccgttgcaggaagctgatttcatggaggtcaccaaaaaagtgggccgggacaccaggaagggggctagggatcccaccgtggaggtgggctccagggagtaggcaccacagcggctgggatggcagacagagaggctccgcaggaggctccgagaggccacactgcctatcgcccttctggctgttctacctcttcaatgccccgaaggtctgagactgcagagcgggggcacggagtgtctcgctaactgggccaggcagtgacgcgggaccggcgcaccctcccacccccaccctaacggcactgacaccggggcaccggcgcgggtccctgcatcagctagctccggagctgcgcgctccacgatggctccgggccgggcagtggccgggctgctgctgctggcggccaccagcctgggacacccctcggagggaccggagctcgccttcagtgaggatgtgctgagcgtgttcggcgccaaccggagcctgtcggccgcgcagctggggcgcctgctggagcgtctgggggctgcatcccagcagggagcgctggacctgggccagctgcacttcaaccagtgtttgtcagcagaagacatcttttctcttcatggtttctcaaatgtcacccagataaccagctcgaacttctctgccatctgccccgcgatcttacagcagctgaacttccatccctgcgaggatctaagaaagcacaacgcaaagcccagtctttccgaagtctggggctatggattcctgtcagtgacaattatcaatctggcctctctcctgggattgattttaacccccttgataaagaagtcttatttccccaagattttaacttatttcgtgggactcgctattgggactcttttctcaaacgccattttccagcttattccagaggcatttggatttaatcccaaaattgacaattacgttgagaaagcagttgctgtgtttggtggattttacatgcttttctttgtcgagagaacacttaagatgctactgaaaacatatggccagaatgaccatactcacttcaggaatgatgactttggttctaaagaaaaaacccaccaacccaaaacgttaccattgcctgcagtcaacggtgtgacttgctatgccaaccccgctgtcactgagcctaacggacacatccacttcgacactgtcagcgttgtatccctccaggatggaaaaacagagccaagctcatgtacctgtctgaaggggcccaaactgtcagaaataggaacaattgcctggatgatcacgctttgtgatgccctccacaatttcatcgacggcttggcgattggggcatcttgtactttgtctcttcttcaggggctcagtacgtccatagcgatcctgtgtgaggagtttcctcatgagttaggggactttgtgatcttgctcaatgcaggaatgagcacccggcaagccttgctgttcaacttcctctccgcgtgttcctgctacgtgggactagctttcggcattttggtgggcaacaattttgctcccaatattatatttgcactcgctggaggcatgttcctctacatttctctggcagatatgtttccagagatgaacgacatgctgagagaaaaagtaactggaagacaaacggatttcaccttcttcatgatccagaatgcagggatgttaaccggcttcactgccatcctgctcatcaccttgtacgcaggagacatcgaattgcagtagccggaagtggagtataacgtcaacgcgggaaggcatttaataacaacacagaaacatctccatagggatttttgtttttttaaaagtatatcctatttagttaaaagagattttttttttattattttcaactaaaggctaaggaatctaatgactggtttcagatatgtagaataggtgaaatttgttgttaaaatttttccttaaaaggttttcggtttcagactgcaaaggctggtgtatggggcctttggtaaatacctggttttcaatattttatgcatattagaaaattatcatgaagcaaacacgtgcattcacaagcagacatacagatccagagaaaaacacaatctgggtcatgtaaggtttcagaacttgcttgggtaaacaacaacaacaacaacaacaacaacaacaacaacaaaaacctcaagcgttttcagagtggttttcttccaattaatgtgtttgactgcttttaaaggcaggtgcatcaaatgaggaagaaaatcaagacagacagctccagtgcatgcaggaccgatcccagtgccttaacgaaccccagaaagatagcgcacagcgtttgttcagctttatgtctcagttggcgacctgtaggattgttttgaaagctaatacaaagtaacatgaattaggaaaggatgaaaggcttgctagcccagcaaggcttgggctcagggcttggtccctgagttataagcttgaacacaccctgcagaagaccagaattgctttgctatgatttatgctgtggttccagccaacagaaatgcctgaggagtatgcgagactggttagaactcagtcttgccatgctctgggattgctttgtcatggtggagaatatgttgggtgggagagagaaattgaatgtaattgtgagcaatttactttttaaaagatgagcataattatttagcagggggaatttcaataaatgcaaaaatcacagctgggctgggctgtgtcagagactgatggtggaggaggcatgtgctcattaggggtgattgacagtcagcagagacggcttcttttatgtgcagtgtgctttgttcccatatggtataccgttggatggaaaacctcagcatactctttctacctttcgtaaaacacacagctcactgagtgtttgagcacgttgtagacgatcagtctgaattgaacatcctaatttcaattcacactcccaagtaacttaaaaaaaagatgatttgacagtgatgagaattagtaatagaagccaagttatctcaggaattatgttttcctataagcccaaacacattttcatgtaataacagtgcagatttgataaactttaacatatatgtttatgtgtattctcactttatgactgacaattaaaaaatattatttgaccaaacagtaaaagcttttgaaaccatgtaccgtgtcagttatttttctcttaatatgtctttattttgagtgacatcatgtggctggtgttatgagaagagaggcaagtagagaactgatgttgtattattttaaaaatatctagcaaaaaaatcctacaaagactaatttttcatttcaataaacacaatctatattagtataa

SEQ ID NO: 13 - DNA, 3097 bp, Rattus norvegicus
cctttgttccttttatctcaggctccgcaggaggcccggagaggccacactgcctaccgtcctcctggctgtggtacctcttcaatgccccgaaggtctgaggctgcagaggagcgggggcaccgagcttctcgctaactggggcaggcagtgacgtgagaccggcggacctcccacccccaccctaagggcaccgacacccgggcactcgctcggatccctgcatccgctagctccggagctgcgcgctccacgatggctccgggccgggcagtggccgggctgctgctactggcggccaccggcctgggacgcccctcggaggggccggagctcgccttcactgaggatgtgctgagagtgttcggcgccaaccagagcctgtcggccgcgcagctggggcgcctgctggagcgcctgggggctgcaccccagcagggagcgctggagctgggccagctccacttcaaccagtgtctgtcagcggaagacatcttttctcttcatggtttctcaaacgtcacccagataaccagctcgaacttcactgccatctgccctgcgatcttacagcagctgaactttcatccctgtgaggatccacagaagcacagcgtaaagcccagtttttccgaagtctggggctatggattcttgtcagtgacaatcatcaatttggcctctctcctgggattgattttaacccccttgataaagaagtcgtatttccccaagattttgacttattttgtggggctggctattgggacccttttctcaaatgccattttccagcttattccagaggcatttggatttaatcccaaaattgacaattatgttgaaaaggcagttgctgtgtttggtggattttacatgcttttctttgttgaaagaacacttaagatgctactgaaaacgtacggccagaatgaccatactcacttcaggaatgatgacttcggttctaaagaaaaagcccatcaacccaaaacgttgccattacctcctgtcaatggagtgacatgctatgccaaccccgctgtcactgagcctaatggacacatccacttcgacactgtcagtgttgtgtccctgcaggatggaaaagcagagtcaagttcatgcacctgtttgaaggggcccaaactgtcagaaataggaacgattgcttggatgatcacgctctgtgatgcccttcacaatttcattgatggcttggcgatcggggcatcctatactctgtctcttcttcaaggactcagtacttccatagcgatcctgtgtgaggagtttcctcatgagttaggggactttgtgatcttgctcaatgcagggatgagcactcggcaagccttgctgtttaacttcctctctgcatgttcctgctacgttgggcttgctttcggcattttggtgggcaacaactttgctccaaatattatatttgcacttgctggaggcatgttcctttacatttctctggcagatatgtttccagagatgaacgacatgctgagagaaaaagtaactggaagacaaacggacttcaccttcttcatgatccagaacgcagggatgttaaccggattcactgccatcttgctcatcaccttgtacgcaggggacatcgaattgcagtagctgggagtatgacgtcagcgcggcaaggcatttaataaacaacaacacagaagaaacatctccatagggaatttttttaaaaaagtgtatcctatttagttaaaagagattttttttttaaattttcaactagaggctaagaaatctaatgactggtttcagacacgtagaataggtgaaatttgttgttaaaaatttctttaaaaggttttcggtttcagtctgaaatggctggtgtatggggcctttggtaaatacctgtttttcaatattttatgcctattagaaaattatcatgaagcaaacacatgcattcagtagcagacatacagacccagagaaaaacacaatctgagtcatgcaaggctttagaacttggttggattaaacacacacacacacacacacacacacacacacacacacacacacacacacacacgtgttttcagggtggttttcttccgattaatgtgttcgtctgcttttaaaggcaggtgcttcaaatgtggaaggaaatcaaaacagttccagtgcatgcaggaaggattccagtgccttaatgaaccccagagagattgtgcacagcgtttgttcagctttttgtctcagttggcgacctgtaggattgttttgaaagctatcccaaagtaacatgaattaggaaaggatgagagtcttgctagccaggtgaagcttgggcttagtgcttggtccctgagtatataagcttgaacacactctgcagaagaccagaatttgctgtgctgtgacttaggttgtggttccagacaacagaaatggccgaggagtaagactggtcagaacgcagtcgtgccgtgctctgggattgctttgtaagggtgaagaatgtgttgggtgggagagagaaattgaatataattttgagcaatttacttttttaaaggtgagcataattatttagcagggaggatttcaataaatgcaaaataacagctgggctgggctgtgtcagagactgatggtggaggaagcgtgtgttcattaggggtgactgacagtcagaaacatcttcttttatgcccagcatactttgttcccatatgctatacctttggatggaaaacactcaacatactgtgcttatttttctacctttggtaaaacacagagctcgctgagtttttgagcaggctgtagacaattagtctgaattgaacatcccaatctcaattcacactcccaaggaacccaaaagagatgatttgacagtgatgaggatgattaatagaacacaacttatcccaggattgtgtttccctataagccaaaacacattttcatgtaagaacaatgcaaactcgataaacgttaacatatatgtttgtgtgtttcactctatgactgacaattaaaacttatttgaccagacagtaaacgattttaaaaaaaaaaaaaaaaaaaaaaaaaa

SEQ ID NO: 14 - DNA, 3159 bp, Macaca fascicularis
agcggatcgcggagtttcactgcggacctgtcagagatacagaggttgtgggggcgggagacagaaagagagagatccagagaccgagtctcacgttgacacgcagacagaaagacgcagagacaaacagaaacaaacagataggagaggctctccaggaggccggggggcccactccgcctatcgctccccgcggcttcgctgccacttcaatgccccgcaggtcgcgagctgctgttctttcgaaggcgtcggagaaccagaggcgtcccgcgccacctctgactcggagcagcgccgagcactgacgctcgcgcccttgggcacggacgccagtgcgcccgcgcgcgtccctctgcgcggcagccagtcacgggccctcaaggggaagcccaggccaggatgaccccgggccgggcggtggccgggctcctgctgctggcggccgccggccttggaggagtggcggagggaccagggctcgccttcagcgaggatgtgctgagcgtgttcggcgcgaatctgagtctgtcggcggcgcagctccagcacttgctggagcagatgggagccgcctcccgcgtgggcgtcccggagcctggccagctgcacttcaaccagtgtttaaccgctgaagagatcttttcccttcatggcttttcaaatgctacccaaataaccagctccaaattctctgtcatctgtccagcagtcttacagcaattgaactttcacccttgtgaggatcggcccaagcacaaaacaagaccaagtcattcagaagtttggggatatggattcctgtcagtgacaattattaatttggcttctctcctcggattgattttgactccactgataaagaaatcttatttcccaaagattttgaccttttttgtggggctggctattgggactcttttttcaaatgcaattttccaacttattccagaggcatttggatttgatcccaaagtcgacagttatgttgagaaggcagttgctgtgtttggtggattttacctacttttcttttttgaaagaatgcttaagatgttattaaagacatatggtcagaatggtcatacccactttggaaatgataactttggtcctcaagaaaaaactcatcaacctaaagcattacctgccatcaatggtgtgacgtgctatgcaaatcctgctgtcacagaagctaatggacatatccattttgataatgtcagtgtggtatctctacaggatggaaaaaaagagccaagttcatgtacctgtttgaaggggcccaaactgtcagaaatagggacgattgcctggatgataacgctctgcgatgccctccacaatttcatcgatggcctggcgattggggcttcctgcaccttgtctctccttcagggactcagtacttccatagcaatcctatgtgaggaatttccccacgagttaggagactttgtgatcctactcaatgcagggatgagcactcgacaagccttgctattcaacttcctttctgcatgttcctgctatgttgggctagcttttggcattttggtgggcaacaatttcgctccaaatattatatttgcacttgctggaggcatgttcctctatatttctctggcagatatgtttccagagatgaatgatatgctgagagaaaaggtaactggaagaaaaaccgatttcaccttcttcatgattcagaatgctggaatgttaactggattcacagccattctgctcattaccttgtatgcaggagaaatcgaattggagtaatagaaaatggaagatggtgttgttaataaaggcatttaatagataaaaacatctccaaaagggattttgaagctgatcctatttagttaaaaagataattttgctttcaactgtaggtcaagaaaactaattattggtgtcagtctgtgaaatagtccattctttgttgttaaaaatgcttcagaaggttttcagtgtcagtcggagatgcctggtatataggaatctttgggaaatacctatttttcagtatttcatgcatactggatatcaccatgaagcaagagacatgcattctataatcatgtagacactcagactcgggaaaatacaagttacctcttgaaagcctttaaaactctatggtaggatcaaaggttcaagtggtttcagagaggttttatttcaattaatttgttctagtgctttcaagagcaagtacatcaaaatgtagaaggtaaaatgtatgcaacactaatataaatgattccaagtctttaaagagccaaagaaaaaaagatttctcacagctttttgttctgttttgtatttcaattaggaacttacaggattattttgaaaaccgttctaaaataataggagttaggaaattaataaagttttgctagccctgctaagttcaggcttagagacttatcgctaagtgtaaacttcaccagattcacgaaaagctggatagctttttttctgacttatgttgtggttgcacccctcacaaatggcagaacagtatgtaaagctggtaacacctcagtttcagtgcaccatgtgtttgctttgtgaaggtgaagaatatgttggtttagagaaagaaattggatgtaattttatgcaatttacttttaaagacgaacataattagttagcagagaatattttaataagtgcaaaacaacagctggactgctgtacatcaaggactgattaactggaaaacatatgttccttatgtgtgatcgagagctgttcagaaaagacttctttgtgttcagcctacacttttccatatggcataccttgaaaaaaattagcacaccatggttatttttctaccttttataaaagatagagcctgtttactcatttagaagatagagaaaattggtctaaaattgaacatcttagattcacactcccaagtcacttaaggaaagatgatttgatggtgaggaaaatgatggacaaagcccaacaatgatctcaggaattacattttccaacagaccaaaaaatgttttcacgtagcagcaatgcggatttggtgaatatttaatatatattttagtatatatttcactttatgaactccaattaaaaattgtttgaccaaatagtaaacaccttttgaaacca

SEQ ID NO: 15 - DNA, 3152 bp, Homo sapiens
tggtttcaaaagggtgtttactatttggccaaacaatattttttaattgtcagtcataaagtgaaatacatactaaaatatatattaaatattcaccaaatctgcattgctgctacatgaaaacattttttggtctgttggaaaatgtaattcctgagatcattgttgggctttgtcaatcattttcctcaccatcaaatcaccttaagtgacttgggagtgtgaatctaggatgttcaattttagaccaattttctctatcttctaaatgagtaaacaggctctgtcttttataaaaggtagaaaaataaccatggtgtgctaatttttttcaaggtataccatatggaaaagtataggctgaacacaaaggaagtcttttctgaatggctctcgatcacacataaggaacatatgttttccagttaatctgtccttgatgtacagcagtccagctgttgttttgcatttattaaaatattctctgctaaatagttatgtttgtctttaaaagtaaattgcataaaattacatccaatttctttctctaaaccaacatattcttcaccttcacaaagcaaacacatggtgcactgaaaccgaggtgttaccagctttacatactgttctgccatttgtgaggggtgcaaccacaacataagtcagaaaaaaagctatccagcttttcgtggaatctggtgaagtttatacttagcgataagcctctaagcctgaacttagcagggctagcaaaactttatttatttcctaactcctattattttagaatggttttcaaaataatactgcaagttcctaattgaaatacaaaacagaacaaaaagctgtgagaaatcttttttttctttggctccttaaagacttggaataatttatattagtgttgcatacattttaccttctacattttgatgtacttgctcttgaaagcactagaacaaattaattgaaataaaacctctctgaaaccatttgaatctttgatcctaccatagagttttaaaggctttcaggatataacttgtattttcccctgagtctgagtgtctacatgattatagaatgcatgtctcttgcttcatggtgatatctaatatgcatggaatactgaaaaataggtatttcccaaaggctcctatataccaggcatctcagactgacactgaaaaccttttgaagcatttttaacaacaaataatggactatttcacagactgatgccaataattagttttctggacctacagttgaaagcaaaattatctttttaactaaataggatcagcttcaaaatcctttttggagatgtttttatctattaaatgcctttattaacaacaccatcttccattttctattactccaattcgatttctcctgcatacaaggtaatgagtagaatggctgtgaatccagttaacattccagcattctgaatcatgaagaaggtgaaatcggtttttcttccagttaccttttctctcagcatatcattcatctctggaaacatatctgccagagaaatatagaggaacatgcctccagcaagtgcaaatataatatttggagcgaaattgttgcccaccaaaatgccaaaagctagcccaacatagcaggaacatgcagaaaggaagttgaatagcaaggcttgtcgagtgctcatccctgcattgagtaggatcacaaagtctcctaactcgtggggaaactcctcacataggattgctatggaagtactgagtccctgaaggagagacaaggtgcaggaagccccaatcgccaggccatcgatgaaattgtggagggcatcgcagagcgttatcatccaggcaatcgtccctatttctgacagtttgggccccttcaaacaggtacatgaacttggctctttttttccatcctgtagagataccacactgacattatcaaaatggatatgtccattagcttctgtgacagcaggatttgcatagcatgtcacaccattgatggcaggtaatgctttaggttgatgagttttttcttgaggaccaaagttatcatttccaaagtgggtatgaccattctgaccatatgtctttaataacatctttagcattctttcaaaaaagaaaagtaggtaaaatccaccaaacacagcaactgccttctcaacataactgtcgactttgggatcaaatccaaatgcctctggaataagttggaaaattgcatttgaaaaaagagtcccaatagccagccccacaaaaaaggtcaaaatctttgggaaataagatttctttatcagtggagtcaaaatcaatccgaggagagatgccagattaataatcgtcactgacaggaatccatatccccaaacttctgaatgacttggtcttgttttgtgcttgggccgatcctcacatgggtgaaagttcaattgctgtaagactgctggacagatgacagagaatttggagctggttatttgggtagcatttgaaaagccatgaagggaaaagatctcttcagcagttaaacactggttgaagtgcagctggccaggctccgggacgcccacgcgggaggcggctcccatctgctccagcaagtgctggagctgcgccgccgacaggctcagattcgcgccgaacacgctcagcacatcctcgctgaaggctagccctggcccctccgccactcctccgaggccggcggccgccagcaacaggagcccggccaccgcgcgacccggggccatcctggcctgggcttccccttgagggcccgcgacgggctgccgcgcagagggacgcgcgcgggcgcactggcgtccttgcccaagggcgggagcgtcagtgctcggcgctgctccgagtcagaggtggcgcgggacgcccctggttctccgacgccttcgaaagaacagcagctcgcgacctgcggggcattgaagtggcagcgtagccgaggggagcgataggcggagtgggccccccggcctcctggagagcctctcctatctgtttgtttgtctgtctctgcgtctttctctctgcgtgtcaacgtaagactcggtctctggatctctctctctttctgtctcccgcccccacaacctctgtatctctgacaggtccgcggtgaaactc

SEQ ID NO: 16 - DNA, 3492 bp, Mus musculus
ttatactaatatagattgtgtttattgaaatgaaaaattagtctttgtaggatttttttgctagatatttttaaaataatacaacatcagttctctacttgcctctcttctcataacaccagccacatgatgtcactcaaaataaagacatattaagagaaaaataactgacacggtacatggtttcaaaagcttttactgtttggtcaaataatattttttaattgtcagtcataaagtgagaatacacataaacatatatgttaaagtttatcaaatctgcactgttattacatgaaaatgtgtttgggcttataggaaaacataattcctgagataacttggcttctattactaattctcatcactgtcaaatcatcttttttttaagttacttgggagtgtgaattgaaattaggatgttcaattcagactgatcgtctacaacgtgctcaaacactcagtgagctgtgtgttttacgaaaggtagaaagagtatgctgaggttttccatccaacggtataccatatgggaacaaagcacactgcacataaaagaagccgtctctgctgactgtcaatcacccctaatgagcacatgcctcctccaccatcagtctctgacacagcccagcccagctgtgatttttgcatttattgaaattccccctgctaaataattatgctcatcttttaaaaagtaaattgctcacaattacattcaatttctctctcccacccaacatattctccaccatgacaaagcaatcccagagcatggcaagactgagttctaaccagtctcgcatactcctcaggcatttctgttggctggaaccacagcataaatcatagcaaagcaattctggtcttctgcagggtgtgttcaagcttataactcagggaccaagccctgagcccaagccttgctgggctagcaagcctttcatcctttcctaattcatgttactttgtattagctttcaaaacaatcctacaggtcgccaactgagacataaagctgaacaaacgctgtgcgctatctttctggggttcgttaaggcactgggatcggtcctgcatgcactggagctgtctgtcttgattttcttcctcatttgatgcacctgcctttaaaagcagtcaaacacattaattggaagaaaaccactctgaaaacgcttgaggtttttgttgttgttgttgttgttgttgttgttgttgttgtttacccaagcaagttctgaaaccttacatgacccagattgtgtttttctctggatctgtatgtctgcttgtgaatgcacgtgtttgcttcatgataattttctaatatgcataaaatattgaaaaccaggtatttaccaaaggccccatacaccagcctttgcagtctgaaaccgaaaaccttttaaggaaaaattttaacaacaaatttcacctattctacatatctgaaaccagtcattagattccttagcctttagttgaaaataataaaaaaaaaatctcttttaactaaataggatatacttttaaaaaaacaaaaatccctatggagatgtttctgtgttgttattaaatgccttcccgcgttgacgttatactccacttccggctactgcaattcgatgtctcctgcgtacaaggtgatgagcaggatggcagtgaagccggttaacatccctgcattctggatcatgaagaaggtgaaatccgtttgtcttccagttactttttctctcagcatgtcgttcatctctggaaacatatctgccagagaaatgtagaggaacatgcctccagcgagtgcaaatataatattgggagcaaaattgttgcccaccaaaatgccgaaagctagtcccacgtagcaggaacacgcggagaggaagttgaacagcaaggcttgccgggtgctcattcctgcattgagcaagatcacaaagtcccctaactcatgaggaaactcctcacacaggatcgctatggacgtactgagcccctgaagaagagacaaagtacaagatgccccaatcgccaagccgtcgatgaaattgtggagggcatcacaaagcgtgatcatccaggcaattgttcctatttctgacagtttgggccccttcagacaggtacatgagcttggctctgtttttccatcctggagggatacaacgctgacagtgtcgaagtggatgtgtccgttaggctcagtgacagcggggttggcatagcaagtcacaccgttgactgcaggcaatggtaacgttttgggttggtgggttttttctttagaaccaaagtcatcattcctgaagtgagtatggtcattctggccatatgttttcagtagcatcttaagtgttctctcgacaaagaaaagcatgtaaaatccaccaaacacagcaactgctttctcaacgtaattgtcaattttgggattaaatccaaatgcctctggaataagctggaaaatggcgtttgagaaaagagtcccaatagcgagtcccacgaaataagttaaaatcttggggaaataagacttctttatcaagggggttaaaatcaatcccaggagagaggccagattgataattgtcactgacaggaatccatagccccagacttcggaaagactgggctttgcgttgtgctttcttagatcctcgcagggatggaagttcagctgctgtaagatcgcggggcagatggcagagaagttcgagctggttatctgggtgacatttgagaaaccatgaagagaaaagatgtcttctgctgacaaacactggttgaagtgcagctggcccaggtccagcgctccctgctgggatgcagcccccagacgctccagcaggcgccccagctgcgcggccgacaggctccggttggcgccgaacacgctcagcacatcctcactgaaggcgagctccggtccctccgaggggtgtcccaggctggtggccgccagcagcagcagcccggccactgcccggcccggagccatcgtggagcgcgcagctccggagctagctgatgcagggacccgcgccggtgccccggtgtcagtgccgttagggtgggggtgggagggtgcgccggtcccgcgtcactgcctggcccagttagcgagacactccgtgcccccgctctgcagtctcagaccttcggggcattgaagaggtagaacagccagaagggcgataggcagtgtggcctctcggagcctcctgcggagcctctctgtctgccatcccagccgctgtggtgcctactccctggagcccacctccacggtgggatccctagcccccttcctggtgtcccggcccacttttttggtgacctccatgaaatcagcttcctgcaacggtgtctagagccccttgcattgtctcaaaaatgaacaggaattggttttttgcctcacttcttaaaaatcagaggagaaagaggaaaccaaatcagtcgcaagttggtgggctagctgag

SEQ ID NO: 17 - DNA, 3097 bp, Rattus norvegicus
ttttttttttttttttttttttttttaaaatcgtttactgtctggtcaaataagttttaattgtcagtcatagagtgaaacacacaaacatatatgttaacgtttatcgagtttgcattgttcttacatgaaaatgtgttttggcttatagggaaacacaatcctgggataagttgtgttctattaatcatcctcatcactgtcaaatcatctcttttgggttccttgggagtgtgaattgagattgggatgttcaattcagactaattgtctacagcctgctcaaaaactcagcgagctctgtgttttaccaaaggtagaaaaataagcacagtatgttgagtgttttccatccaaaggtatagcatatgggaacaaagtatgctgggcataaaagaagatgtttctgactgtcagtcacccctaatgaacacacgcttcctccaccatcagtctctgacacagcccagcccagctgttattttgcatttattgaaatcctccctgctaaataattatgctcacctttaaaaaagtaaattgctcaaaattatattcaatttctctctcccacccaacacattcttcacccttacaaagcaatcccagagcacggcacgactgcgttctgaccagtcttactcctcggccatttctgttgtctggaaccacaacctaagtcacagcacagcaaattctggtcttctgcagagtgtgttcaagcttatatactcagggaccaagcactaagcccaagcttcacctggctagcaagactctcatcctttcctaattcatgttactttgggatagctttcaaaacaatcctacaggtcgccaactgagacaaaaagctgaacaaacgctgtgcacaatctctctggggttcattaaggcactggaatccttcctgcatgcactggaactgttttgatttccttccacatttgaagcacctgcctttaaaagcagacgaacacattaatcggaagaaaaccaccctgaaaacacgtgtgtgtgtgtgtgtgtgtgtgtgtgtgtgtgtgtgtgtgtgtgtgtgtgtgtttaatccaaccaagttctaaagccttgcatgactcagattgtgtttttctctgggtctgtatgtctgctactgaatgcatgtgtttgcttcatgataattttctaataggcataaaatattgaaaaacaggtatttaccaaaggccccatacaccagccatttcagactgaaaccgaaaaccttttaaagaaatttttaacaacaaatttcacctattctacgtgtctgaaaccagtcattagatttcttagcctctagttgaaaatttaaaaaaaaaatctcttttaactaaataggatacacttttttaaaaaaattccctatggagatgtttcttctgtgttgttgtttattaaatgccttgccgcgctgacgtcatactcccagctactgcaattcgatgtcccctgcgtacaaggtgatgagcaagatggcagtgaatccggttaacatccctgcgttctggatcatgaagaaggtgaagtccgtttgtcttccagttactttttctctcagcatgtcgttcatctctggaaacatatctgccagagaaatgtaaaggaacatgcctccagcaagtgcaaatataatatttggagcaaagttgttgcccaccaaaatgccgaaagcaagcccaacgtagcaggaacatgcagagaggaagttaaacagcaaggcttgccgagtgctcatccctgcattgagcaagatcacaaagtcccctaactcatgaggaaactcctcacacaggatcgctatggaagtactgagtccttgaagaagagacagagtataggatgccccgatcgccaagccatcaatgaaattgtgaagggcatcacagagcgtgatcatccaagcaatcgttcctatttctgacagtttgggccccttcaaacaggtgcatgaacttgactctgcttttccatcctgcagggacacaacactgacagtgtcgaagtggatgtgtccattaggctcagtgacagcggggttggcatagcatgtcactccattgacaggaggtaatggcaacgttttgggttgatgggctttttctttagaaccgaagtcatcattcctgaagtgagtatggtcattctggccgtacgttttcagtagcatcttaagtgttctttcaacaaagaaaagcatgtaaaatccaccaaacacagcaactgccttttcaacataattgtcaattttgggattaaatccaaatgcctctggaataagctggaaaatggcatttgagaaaagggtcccaatagccagccccacaaaataagtcaaaatcttggggaaatacgacttctttatcaagggggttaaaatcaatcccaggagagaggccaaattgatgattgtcactgacaagaatccatagccccagacttcggaaaaactgggctttacgctgtgcttctgtggatcctcacagggatgaaagttcagctgctgtaagatcgcagggcagatggcagtgaagttcgagctggttatctgggtgacgtttgagaaaccatgaagagaaaagatgtcttccgctgacagacactggttgaagtggagctggcccagctccagcgctccctgctggggtgcagcccccaggcgctccagcaggcgccccagctgcgcggccgacaggctctggttggcgccgaacactctcagcacatcctcagtgaaggcgagctccggcccctccgaggggcgtcccaggccggtggccgccagtagcagcagcccggccactgcccggcccggagccatcgtggagcgcgcagctccggagctagcggatgcagggatccgagcgagtgcccgggtgtcggtgcccttagggtgggggtgggaggtccgccggtctcacgtcactgcctgccccagttagcgagaagctcggtgcccccgctcctctgcagcctcagaccttcggggcattgaagaggtaccacagccaggaggacggtaggcagtgtggcctctccgggcctcctgcggagcctgagataaaaggaacaaagg

SEQ ID NO: 18 - DNA, 3159 bp, Macaca fascicularis
tggtttcaaaaggtgtttactatttggtcaaacaatttttaattggagttcataaagtgaaatatatactaaaatatatattaaatattcaccaaatccgcattgctgctacgtgaaaacattttttggtctgttggaaaatgtaattcctgagatcattgttgggctttgtccatcattttcctcaccatcaaatcatctttccttaagtgacttgggagtgtgaatctaagatgttcaattttagaccaattttctctatcttctaaatgagtaaacaggctctatcttttataaaaggtagaaaaataaccatggtgtgctaatttttttcaaggtatgccatatggaaaagtgtaggctgaacacaaagaagtcttttctgaacagctctcgatcacacataaggaacatatgttttccagttaatcagtccttgatgtacagcagtccagctgttgttttgcacttattaaaatattctctgctaactaattatgttcgtctttaaaagtaaattgcataaaattacatccaatttctttctctaaaccaacatattcttcaccttcacaaagcaaacacatggtgcactgaaactgaggtgttaccagctttacatactgttctgccatttgtgaggggtgcaaccacaacataagtcagaaaaaaagctatccagcttttcgtgaatctggtgaagtttacacttagcgataagtctctaagcctgaacttagcagggctagcaaaactttattaatttcctaactcctattattttagaacggttttcaaaataatcctgtaagttcctaattgaaatacaaaacagaacaaaaagctgtgagaaatctttttttctttggctctttaaagacttggaatcatttatattagtgttgcatacattttaccttctacattttgatgtacttgctcttgaaagcactagaacaaattaattgaaataaaacctctctgaaaccacttgaacctttgatcctaccatagagttttaaaggctttcaagaggtaacttgtattttcccgagtctgagtgtctacatgattatagaatgcatgtctcttgcttcatggtgatatccagtatgcatgaaatactgaaaaataggtatttcccaaagattcctatataccaggcatctccgactgacactgaaaaccttctgaagcatttttaacaacaaagaatggactatttcacagactgacaccaataattagttttcttgacctacagttgaaagcaaaattatctttttaactaaataggatcagcttcaaaatcccttttggagatgtttttatctattaaatgcctttattaacaacaccatcttccattttctattactccaattcgatttctcctgcatacaaggtaatgagcagaatggctgtgaatccagttaacattccagcattctgaatcatgaagaaggtgaaatcggtttttcttccagttaccttttctctcagcatatcattcatctctggaaacatatctgccagagaaatatagaggaacatgcctccagcaagtgcaaatataatatttggagcgaaattgttgcccaccaaaatgccaaaagctagcccaacatagcaggaacatgcagaaaggaagttgaatagcaaggcttgtcgagtgctcatccctgcattgagtaggatcacaaagtctcctaactcgtggggaaattcctcacataggattgctatggaagtactgagtccctgaaggagagacaaggtgcaggaagccccaatcgccaggccatcgatgaaattgtggagggcatcgcagagcgttatcatccaggcaatcgtccctatttctgacagtttgggccccttcaaacaggtacatgaacttggctctttttttccatcctgtagagataccacactgacattatcaaaatggatatgtccattagcttctgtgacagcaggatttgcatagcacgtcacaccattgatggcaggtaatgctttaggttgatgagttttttcttgaggaccaaagttatcatttccaaagtgggtatgaccattctgaccatatgtctttaataacatcttaagcattctttcaaaaaagaaaagtaggtaaaatccaccaaacacagcaactgccttctcaacataactgtcgactttgggatcaaatccaaatgcctctggaataagttggaaaattgcatttgaaaaaagagtcccaatagccagccccacaaaaaaggtcaaaatctttgggaaataagatttctttatcagtggagtcaaaatcaatccgaggagagaagccaaattaataattgtcactgacaggaatccatatccccaaacttctgaatgacttggtcttgttttgtgcttgggccgatcctcacaagggtgaaagttcaattgctgtaagactgctggacagatgacagagaatttggagctggttatttgggtagcatttgaaaagccatgaagggaaaagatctcttcagcggttaaacactggttgaagtgcagctggccaggctccgggacgcccacgcgggaggcggctcccatctgctccagcaagtgctggagctgcgccgccgacagactcagattcgcgccgaacacgctcagcacatcctcgctgaaggcgagccctggtccctccgccactcctccaaggccggcggccgccagcagcaggagcccggccaccgcccggcccggggtcatcctggcctgggcttccccttgagggcccgtgactggctgccgcgcagagggacgcgcgcgggcgcactggcgtccgtgcccaagggcgcgagcgtcagtgctcggcgctgctccgagtcagaggtggcgcgggacgcctctggttctccgacgccttcgaaagaacagcagctcgcgacctgcggggcattgaagtggcagcgaagccgcggggagcgataggcggagtgggccccccggcctcctggagagcctctcctatctgtttgtttctgtttgtctctgcgtctttctgtctgcgtgtcaacgtgagactcggtctctggatctctctctttctgtctcccgcccccacaacctctgtatctctgacaggtccgcagtgaaactccgcgatccgct

SEQ ID NO: 19 - protein, 16 aa, Unknown
  source: /note="Description of Unknown: RFGF peptide"
AAVALLPAVLLALLAP

SEQ ID NO: 20 - protein, 11 aa, Unknown
  source: /note="Description of Unknown: RFGF analogue peptide"
AALLPVLLAAP

SEQ ID NO: 21 - protein, 13 aa, Human immunodeficiency virus
GRKKRRQRRRPPQ

SEQ ID NO: 22 - protein, 16 aa, Drosophila sp.
RQIKIWFQNRRMKWKK

SEQ ID NO: 23 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuacgcugaguacuucgatt

SEQ ID NO: 24 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgaaguacucagcguaagtt

SEQ ID NO: 25 - RNA, 19 nt, Artificial Sequence
  source: /note="Description of Artificial Sequence: Synthetic oligonucleotide"
ccacuccuuuagacucugg

SEQ ID NO: 26 - RNA, 19 nt, Artificial Sequence
  source: /note="Description of Artificial Sequence: Synthetic oligonucleotide"
cgcguuauaaaaagcggug

SEQ ID NO: 27 - RNA, 19 nt, Artificial Sequence
  source: /note="Description of Artificial Sequence: Synthetic oligonucleotide"
ggcgagacaaucugggagg

SEQ ID NO: 28 - RNA, 19 nt, Artificial Sequence
  source: /note="Description of Artificial Sequence: Synthetic oligonucleotide"
gcuacucuggcaagacgug

SEQ ID NO: 29 - RNA, 19 nt, Artificial Sequence
  source: /note="Description of Artificial Sequence: Synthetic oligonucleotide"
gcucuucaugcuggugcuc

SEQ ID NO: 30 - RNA, 19 nt, Artificial Sequence
  source: /note="Description of Artificial Sequence: Synthetic oligonucleotide"
caccgucgccuucuucgug

SEQ ID NO: 31 - RNA, 19 nt, Artificial Sequence
  source: /note="Description of Artificial Sequence: Synthetic oligonucleotide"
gggcaacuccaucgcgcug

SEQ ID NO: 32 - RNA, 19 nt, Artificial Sequence
  source: /note="Description of Artificial Sequence: Synthetic oligonucleotide"
acuccuucaacaugcucuc

SEQ ID NO: 33 - RNA, 19 nt, Artificial Sequence
  source: /note="Description of Artificial Sequence: Synthetic oligonucleotide"
ccgaccugaucucgcugug

SEQ ID NO: 34 - RNA, 19 nt, Artificial Sequence
  source: /note="Description of Artificial Sequence: Synthetic oligonucleotide"
caacgcggucuuccucacc

SEQ ID NO: 35 - RNA, 19 nt, Artificial Sequence
  source: /note="Description of Artificial Sequence: Synthetic oligonucleotide"
cucugcuucaccaucuucg

SEQ ID NO: 36 - RNA, 19 nt, Artificial Sequence
  source: /note="Description of Artificial Sequence: Synthetic oligonucleotide"
ggugcucaucgucggcguc

SEQ ID NO: 37 - RNA, 19 nt, Artificial Sequence
  source: /note="Description of Artificial Sequence: Synthetic oligonucleotide"
gcuguuggucaacguggug

SEQ ID NO: 38 - RNA, 19 nt, Artificial Sequence
  source: /note="Description of Artificial Sequence: Synthetic oligonucleotide"
ugcucaucuuccaggacug

SEQ ID NO: 39 - RNA, 19 nt, Artificial Sequence
  source: /note="Description of Artificial Sequence: Synthetic oligonucleotide"
ccgccugguucgcgugcug

SEQ ID NO: 40 - RNA, 19 nt, Artificial Sequence
  source: /note="Description of Artificial Sequence: Synthetic oligonucleotide"
accucgguggaaaggaagc

SEQ ID NO: 41 - RNA, 19 nt, Artificial Sequence
  source: /note="Description of Artificial Sequence: Synthetic oligonucleotide"
accguguucgcaaacguag

SEQ ID NO: 42 - RNA, 19 nt, Artificial Sequence
  source: /note="Description of Artificial Sequence: Synthetic oligonucleotide"
aggugauuccuucaacacc

SEQ ID NO: 43 - RNA, 19 nt, Artificial Sequence
  source: /note="Description of Artificial Sequence: Synthetic oligonucleotide"
acccagaaugagccagaag

SEQ ID NO: 44 - RNA, 19 nt, Artificial Sequence
  source: /note="Description of Artificial Sequence: Synthetic oligonucleotide"
cagaagacaugaugaaaaa

SEQ ID NO: 45 - RNA, 19 nt, Artificial Sequence
  source: /note="Description of Artificial Sequence: Synthetic oligonucleotide"
aagucugaagcucugaaua

SEQ ID NO: 46 - RNA, 19 nt, Artificial Sequence
  source: /note="Description of Artificial Sequence: Synthetic oligonucleotide"
cugaauaucagagguguac

SEQ ID NO: 47 - RNA, 19 nt, Artificial Sequence
  source: /note="Description of Artificial Sequence: Synthetic oligonucleotide"
gguguacuuuugcauguga

SEQ ID NO: 48 - RNA, 19 nt, Artificial Sequence
  source: /note="Description of Artificial Sequence: Synthetic oligonucleotide"
cgugguuguggucaucacg

SEQ ID NO: 49 - RNA, 19 nt, Artificial Sequence
  source: /note="Description of Artificial Sequence: Synthetic oligonucleotide"
ucauauucuaugugcuucc

SEQ ID NO: 50 - RNA, 19 nt, Artificial Sequence
  source: /note="Description of Artificial Sequence: Synthetic oligonucleotide"
cccugaagagugaggaccc

SEQ ID NO: 51 - RNA, 19 nt, Artificial Sequence
  source: /note="Description of Artificial Sequence: Synthetic oligonucleotide"
ggacccguguaacuggcag

SEQ ID NO: 52 - RNA, 19 nt, Artificial Sequence
  source: /note="Description of Artificial Sequence: Synthetic oligonucleotide"
cuggcaguguuacauugac

SEQ ID NO: 53 - RNA, 19 nt, Artificial Sequence
  source: /note="Description of Artificial Sequence: Synthetic oligonucleotide"
gacuguccucauggucauc

SEQ ID NO: 54 - RNA, 19 nt, Artificial Sequence
  source: /note="Description of Artificial Sequence: Synthetic oligonucleotide"
ggucaucaucauuuuguca

SEQ ID NO: 55 - RNA, 19 nt, Artificial Sequence
  source: /note="Description of Artificial Sequence: Synthetic oligonucleotide"
uugucaucugccuucccgc

SEQ ID NO: 56 - RNA, 19 nt, Artificial Sequence
  source: /note="Description of Artificial Sequence: Synthetic oligonucleotide"
ucccgcuuaucaaggagac

SEQ ID NO: 57 - RNA, 19 nt, Artificial Sequence
  source: /note="Description of Artificial Sequence: Synthetic oligonucleotide"
ugccauucugcuacagaug

SEQ ID NO: 58 - RNA, 19 nt, Artificial Sequence
  source: /note="Description of Artificial Sequence: Synthetic oligonucleotide"
ucccaaaaggagucaacau

SEQ ID NO: 59 - RNA, 19 nt, Artificial Sequence
  source: /note="Description of Artificial Sequence: Synthetic oligonucleotide"
caacauggaagagcugaug

SEQ ID NO: 60 - RNA, 19 nt, Artificial Sequence
  source: /note="Description of Artificial Sequence: Synthetic oligonucleotide"
gcugaugaguaaacucucu

SEQ ID NO: 61 - RNA, 19 nt, Artificial Sequence
  source: /note="Description of Artificial Sequence: Synthetic oligonucleotide"
ccuggaauuagcaguguac

SEQ ID NO: 62 - RNA, 19 nt, Artificial Sequence
  source: /note="Description of Artificial Sequence: Synthetic oligonucleotide"
aguguacaugaagugcaca

SEQ ID NO: 63 - RNA, 19 nt, Artificial Sequence
  source: /note="Description of Artificial Sequence: Synthetic oligonucleotide"
gcacaucugggaacuugua

SEQ ID NO: 64 - RNA, 19 nt, Artificial Sequence
  source: /note="Description of Artificial Sequence: Synthetic oligonucleotide"
cuuguaaguggaaagauua

SEQ ID NO: 65 - RNA, 19 nt, Artificial Sequence
  source: /note="Description of Artificial Sequence: Synthetic oligonucleotide"
aagauuauugccacccugc

SEQ ID NO: 66 - RNA, 19 nt, Artificial Sequence
  source: /note="Description of Artificial Sequence: Synthetic oligonucleotide"
ucaaguauccuaaggacag

SEQ ID NO: 67 - RNA, 19 nt, Artificial Sequence
  source: /note="Description of Artificial Sequence: Synthetic oligonucleotide"
gggauaucaagaugccagc

SEQ ID NO: 68 - RNA, 19 nt, Artificial Sequence
  source: /note="Description of Artificial Sequence: Synthetic oligonucleotide"
gcacaaaaauucgagaaau

SEQ ID NO: 69 - RNA, 19 nt, Artificial Sequence
  source: /note="Description of Artificial Sequence: Synthetic oligonucleotide"
gagaaaucuuccaccaugc

SEQ ID NO: 70 - RNA, 19 nt, Artificial Sequence
  source: /note="Description of Artificial Sequence: Synthetic oligonucleotide"
aauccacaaugugaccauc

SEQ ID NO: 71 - RNA, 19 nt, Artificial Sequence
  source: /note="Description of Artificial Sequence: Synthetic oligonucleotide"
cauccaguuugaaaaugug

SEQ ID NO: 72 - RNA, 19 nt, Artificial Sequence
  source: /note="Description of Artificial Sequence: Synthetic oligonucleotide"
auguggacuugaaggaacc

SEQ ID NO: 73 - RNA, 19 nt, Artificial Sequence
  source: /note="Description of Artificial Sequence: Synthetic oligonucleotide"
gcagaaggacuuacuguug

SEQ ID NO: 74 - RNA, 19 nt, Artificial Sequence
  source: /note="Description of Artificial Sequence: Synthetic oligonucleotide"
uguugcucugcaacucacc

SEQ ID NO: 75 - RNA, 19 nt, Artificial Sequence
  source: /note="Description of Artificial Sequence: Synthetic oligonucleotide"
ucacccugcaucuccaagg

SEQ ID NO: 76 - RNA, 19 nt, Artificial Sequence
  source: /note="Description of Artificial Sequence: Synthetic oligonucleotide"
gugcuaagcagcuguguug

SEQ ID NO: 77 - RNA, 19 nt, Artificial Sequence
  source: /note="Description of Artificial Sequence: Synthetic oligonucleotide"
gcucacgucaauggcugug

SEQ ID NO: 78 - RNA, 19 nt, Artificial Sequence
  source: /note="Description of Artificial Sequence: Synthetic oligonucleotide"
ugugcugagcacaauggug

SEQ ID NO: 79 - RNA, 19 nt, Artificial Sequence
  source: /note="Description of Artificial Sequence: Synthetic oligonucleotide"
ucucuagacacauacggaa

SEQ ID NO: 80 - RNA, 19 nt, Artificial Sequence
  source: /note="Description of Artificial Sequence: Synthetic oligonucleotide"
acggaagugauggccucag

SEQ ID NO: 81 - RNA, 19 nt, Artificial Sequence
  source: /note="Description of Artificial Sequence: Synthetic oligonucleotide"
ucaguagaagagacgcaag

SEQ ID NO: 82 - RNA, 19 nt, Artificial Sequence
  source: /note="Description of Artificial Sequence: Synthetic oligonucleotide"
acgcaagagaaguggcuau

SEQ ID NO: 83 - RNA, 19 nt, Artificial Sequence
  source: /note="Description of Artificial Sequence: Synthetic oligonucleotide"
uggcuauugaagugucuuu

SEQ ID NO: 84 - RNA, 19 nt, Artificial Sequence
  source: /note="Description of Artificial Sequence: Synthetic oligonucleotide"
ugucuuuggauagcugucu

SEQ ID NO: 85 - RNA, 19 nt, Artificial Sequence
  source: /note="Description of Artificial Sequence: Synthetic oligonucleotide"
gcugucugagugaccacgg

SEQ ID NO: 86 - RNA, 19 nt, Artificial Sequence
  source: /note="Description of Artificial Sequence: Synthetic oligonucleotide"
ggacaaagucuuaacaaaa

SEQ ID NO: 87 - RNA, 19 nt, Artificial Sequence
  source: /note="Description of Artificial Sequence: Synthetic oligonucleotide"
aacaaaacucaggaggacc

SEQ ID NO: 88 - RNA, 19 nt, Artificial Sequence
  source: /note="Description of Artificial Sequence: Synthetic oligonucleotide"
gaccaauguuaugucaaca

SEQ ID NO: 89 - RNA, 19 nt, Artificial Sequence
  source: /note="Description of Artificial Sequence: Synthetic oligonucleotide"
ucaacagaacgcauuuuua

SEQ ID NO: 90 - RNA, 19 nt, Artificial Sequence
  source: /note="Description of Artificial Sequence: Synthetic oligonucleotide"
uuuuaaucugguacucaca

SEQ ID NO: 91 - RNA, 19 nt, Artificial Sequence
  source: /note="Description of Artificial Sequence: Synthetic oligonucleotide"
cucacauaaucagaccaua

SEQ ID NO: 92 - RNA, 19 nt, Artificial Sequence
  source: /note="Description of Artificial Sequence: Synthetic oligonucleotide"
gaccauauagacgaggcac

SEQ ID NO: 93 - RNA, 19 nt, Artificial Sequence
  source: /note="Description of Artificial Sequence: Synthetic oligonucleotide"
gcacuuuggaaccacaagc

SEQ ID NO: 94 - RNA, 19 nt, Artificial Sequence
  source: /note="Description of Artificial Sequence: Synthetic oligonucleotide"
cacaagcuuggcucacaaa

SEQ ID NO: 95 - RNA, 19 nt, Artificial Sequence
  source: /note="Description of Artificial Sequence: Synthetic oligonucleotide"
ucacaaaaagagcuuucug

SEQ ID NO: 96 - RNA, 19 nt, Artificial Sequence
  source: /note="Description of Artificial Sequence: Synthetic oligonucleotide"
cuuucuggguuguaggccc

SEQ ID NO: 97 - RNA, 19 nt, Artificial Sequence
  source: /note="Description of Artificial Sequence: Synthetic oligonucleotide"
cagacuagacuugcagcau

SEQ ID NO: 98 - RNA, 19 nt, Artificial Sequence
  source: /note="Description of Artificial Sequence: Synthetic oligonucleotide"
caugcucuguguucacuag

SEQ ID NO: 99 - RNA, 19 nt, Artificial Sequence
  source: /note="Description of Artificial Sequence: Synthetic oligonucleotide"
ggguuggcuguuugggauu

SEQ ID NO: 100 - RNA, 19 nt, Artificial Sequence
  source: /note="Description of Artificial Sequence: Synthetic oligonucleotide"
ugggauuuuaguuaaacgu

SEQ ID NO: 101 - RNA, 19 nt, Artificial Sequence
  source: /note="Description of Artificial Sequence: Synthetic oligonucleotide"
acgugucugugaauuuuua

SEQ ID NO: 102 - RNA, 19 nt, Artificial Sequence
  source: /note="Description of Artificial Sequence: Synthetic oligonucleotide"
guaacuaacuccuuuccau

SEQ ID NO: 103 - RNA, 19 nt, Artificial Sequence
  source: /note="Description of Artificial Sequence: Synthetic oligonucleotide"
ggugucucaugcugcucuu

SEQ ID NO: 104 - RNA, 19 nt, Artificial Sequence
  source: /note="Description of Artificial Sequence: Synthetic oligonucleotide"
ugcucuuugacuguuucag

SEQ ID NO: 105 - RNA, 19 nt, Artificial Sequence
  source: /note="Description of Artificial Sequence: Synthetic oligonucleotide"
cuugaacaugcauuuucua

SEQ ID NO: 106 - RNA, 19 nt, Artificial Sequence
  source: /note="Description of Artificial Sequence: Synthetic oligonucleotide"
cuaaagcaaacugcacuag

SEQ ID NO: 107 - RNA, 19 nt, Artificial Sequence
  source: /note="Description of Artificial Sequence: Synthetic oligonucleotide"
gcacuaguguauauaucag

SEQ ID NO: 108 - RNA, 19 nt, Artificial Sequence
  source: /note="Description of Artificial Sequence: Synthetic oligonucleotide"
ucagggacauuaaagucug

SEQ ID NO: 109 - RNA, 19 nt, Artificial Sequence
  source: /note="Description of Artificial Sequence: Synthetic oligonucleotide"
gcucaauagcugcggauac

SEQ ID NO: 110 - RNA, 19 nt, Artificial Sequence
  source: /note="Description of Artificial Sequence: Synthetic oligonucleotide"
cggauacaguguucaaaga

SEQ ID NO: 111 - RNA, 19 nt, Artificial Sequence
  source: /note="Description of Artificial Sequence: Synthetic oligonucleotide"
guucuuguuucuaaacuga

SEQ ID NO: 112 - RNA, 19 nt, Artificial Sequence
  source: /note="Description of Artificial Sequence: Synthetic oligonucleotide"
aaacugauuagaacuucua

SEQ ID NO: 113 - RNA, 19 nt, Artificial Sequence
  source: /note="Description of Artificial Sequence: Synthetic oligonucleotide"
acuucuagcuaaugcucag

SEQ ID NO: 114 - RNA, 19 nt, Artificial Sequence
  source: /note="Description of Artificial Sequence: Synthetic oligonucleotide"
gaucauagcuuaaauacau

SEQ ID NO: 115 - RNA, 19 nt, Artificial Sequence
  source: /note="Description of Artificial Sequence: Synthetic oligonucleotide"
aaaaacuaaaguaccacaa

SEQ ID NO: 116 - RNA, 19 nt, Artificial Sequence
  source: /note="Description of Artificial Sequence: Synthetic oligonucleotide"
accacaauagcuguauuuu

SEQ ID NO: 117 - RNA, 19 nt, Artificial Sequence
  source: /note="Description of Artificial Sequence: Synthetic oligonucleotide"
cccuuaacgaucauaaaag

SEQ ID NO: 118 - RNA, 19 nt, Artificial Sequence
  source: /note="Description of Artificial Sequence: Synthetic oligonucleotide"
ggcaaguuaaguauuucug

SEQ ID NO: 119 - RNA, 19 nt, Artificial Sequence
  source: /note="Description of Artificial Sequence: Synthetic oligonucleotide"
gcacugaagaaauaucuuu

SEQ ID NO: 120 - RNA, 19 nt, Artificial Sequence
  source: /note="Description of Artificial Sequence: Synthetic oligonucleotide"
cuuugauucauuuuugaau

SEQ ID NO: 121 - RNA, 19 nt, Artificial Sequence
  source: /note="Description of Artificial Sequence: Synthetic oligonucleotide"
gaauaacuauuaagguaga

SEQ ID NO: 122 - RNA, 19 nt, Artificial Sequence
  source: /note="Description of Artificial Sequence: Synthetic oligonucleotide"
agguagaaaauauucucag

SEQ ID NO: 123 - RNA, 19 nt, Artificial Sequence
  source: /note="Description of Artificial Sequence: Synthetic oligonucleotide"
uucucagaacauucuagag

SEQ ID NO: 124 - RNA, 19 nt, Artificial Sequence
  source: /note="Description of Artificial Sequence: Synthetic oligonucleotide"
gagguaaagguuaguagga

SEQ ID NO: 125 - RNA, 19 nt, Artificial Sequence
  source: /note="Description of Artificial Sequence: Synthetic oligonucleotide"
ccaucucuacauuuuguga

SEQ ID NO: 126 - RNA, 19 nt, Artificial Sequence
  source: /note="Description of Artificial Sequence: Synthetic oligonucleotide"
aggugagagaaaacuaaug

SEQ ID NO: 127 - RNA, 19 nt, Artificial Sequence
  source: /note="Description of Artificial Sequence: Synthetic oligonucleotide"
auguuuacuuucugcugug

SEQ ID NO: 128 - RNA, 19 nt, Artificial Sequence
  source: /note="Description of Artificial Sequence: Synthetic oligonucleotide"
gcugugaacugaacugcag

SEQ ID NO: 129 - RNA, 19 nt, Artificial Sequence
  source: /note="Description of Artificial Sequence: Synthetic oligonucleotide"
cagcuauagaauguuucaa

SEQ ID NO: 130 - RNA, 19 nt, Artificial Sequence
  source: /note="Description of Artificial Sequence: Synthetic oligonucleotide"
guuucaaaugcuuaaauau

SEQ ID NO: 131 - RNA, 19 nt, Artificial Sequence
  source: /note="Description of Artificial Sequence: Synthetic oligonucleotide"
uuuuccauggaagugaggg

SEQ ID NO: 132 - RNA, 19 nt, Artificial Sequence
  source: /note="Description of Artificial Sequence: Synthetic oligonucleotide"
agggaauauuucaguuucc

SEQ ID NO: 133 - RNA, 19 nt, Artificial Sequence
  source: /note="Description of Artificial Sequence: Synthetic oligonucleotide"
uuuccugaaguaugacaca

SEQ ID NO: 134 - RNA, 19 nt, Artificial Sequence
  source: /note="Description of Artificial Sequence: Synthetic oligonucleotide"
acucauauacugucuuuua

SEQ ID NO: 135 - RNA, 19 nt, Artificial Sequence
  source: /note="Description of Artificial Sequence: Synthetic oligonucleotide"
uagagucaguauaguugga

SEQ ID NO: 136 - RNA, 19 nt, Artificial Sequence
  source: /note="Description of Artificial Sequence: Synthetic oligonucleotide"
gcuguuuucauuuagugcu

SEQ ID NO: 137 - RNA, 19 nt, Artificial Sequence
  source: /note="Description of Artificial Sequence: Synthetic oligonucleotide"
gugcuuugauaaugauuua

SEQ ID NO: 138 - RNA, 19 nt, Artificial Sequence
  source: /note="Description of Artificial Sequence: Synthetic oligonucleotide"
gauuuacuuauuuuuccaa

SEQ ID NO: 139 - RNA, 19 nt, Artificial Sequence
  source: /note="Description of Artificial Sequence: Synthetic oligonucleotide"
uccaaauuucguuugaauu

SEQ ID NO: 140 - RNA, 19 nt, Artificial Sequence
  source: /note="Description of Artificial Sequence: Synthetic oligonucleotide"
cuuucauaugauugcauug

SEQ ID NO: 141 - RNA, 19 nt, Artificial Sequence
  source: /note="Description of Artificial Sequence: Synthetic oligonucleotide"
ugcauugaucuaugcagca

SEQ ID NO: 142 - RNA, 19 nt, Artificial Sequence
  source: /note="Description of Artificial Sequence: Synthetic oligonucleotide"
gcagcauuuaccagaaaag

SEQ ID NO: 143 - RNA, 19 nt, Artificial Sequence
  source: /note="Description of Artificial Sequence: Synthetic oligonucleotide"
aagaguauuccugggauag

SEQ ID NO: 144 - RNA, 19 nt, Artificial Sequence
  source: /note="Description of Artificial Sequence: Synthetic oligonucleotide"
agcagaaugcauaacacug

SEQ ID NO: 145 - RNA, 19 nt, Artificial Sequence
  source: /note="Description of Artificial Sequence: Synthetic oligonucleotide"
acacugaguguuaauucuu

SEQ ID NO: 146 - RNA, 19 nt, Artificial Sequence
  source: /note="Description of Artificial Sequence: Synthetic oligonucleotide"
auaaauaagcuagacugcc

SEQ ID NO: 147 - RNA, 19 nt, Artificial Sequence
  source: /note="Description of Artificial Sequence: Synthetic oligonucleotide"
acugccuucucuuuaauua

SEQ ID NO: 148 - RNA, 19 nt, Artificial Sequence
  source: /note="Description of Artificial Sequence: Synthetic oligonucleotide"
guauuuauuauaguuguca

SEQ ID NO: 149 - RNA, 19 nt, Artificial Sequence
  source: /note="Description of Artificial Sequence: Synthetic oligonucleotide"
ugucaacuaguaacucaau

SEQ ID NO: 150 - RNA, 19 nt, Artificial Sequence
  source: /note="Description of Artificial Sequence: Synthetic oligonucleotide"
acucaaugaaaaaguugau

SEQ ID NO: 151 - RNA, 19 nt, Artificial Sequence
  source: /note="Description of Artificial Sequence: Synthetic oligonucleotide"
ccaagggagaaaugagaau

SEQ ID NO: 152 - RNA, 19 nt, Artificial Sequence
  source: /note="Description of Artificial Sequence: Synthetic oligonucleotide"
ugagaauuagcuuaauugc

SEQ ID NO: 153 - RNA, 19 nt, Artificial Sequence
  source: /note="Description of Artificial Sequence: Synthetic oligonucleotide"
cugccuuuaauguguuuuu

SEQ ID NO: 154 - RNA, 19 nt, Artificial Sequence
  source: /note="Description of Artificial Sequence: Synthetic oligonucleotide"
gaggaacuuaaaauuuucu

SEQ ID NO: 155 - RNA, 19 nt, Artificial Sequence
  source: /note="Description of Artificial Sequence: Synthetic oligonucleotide"
auuuucuuucaugucgcug

SEQ ID NO: 156 - RNA, 19 nt, Artificial Sequence
  source: /note="Description of Artificial Sequence: Synthetic oligonucleotide"
gcugauccauauuaccaag

SEQ ID NO: 157 - RNA, 19 nt, Artificial Sequence
  source: /note="Description of Artificial Sequence: Synthetic oligonucleotide"
ccaaguucaaauaaaauuu

SEQ ID NO: 158 - RNA, 19 nt, Artificial Sequence
  source: /note="Description of Artificial Sequence: Synthetic oligonucleotide"
uuuauaaucggauucagac

SEQ ID NO: 159 - RNA, 19 nt, Artificial Sequence
  source: /note="Description of Artificial Sequence: Synthetic oligonucleotide"
cccauaaccaaacuaaaaa

SEQ ID NO: 160 - RNA, 19 nt, Artificial Sequence
  source: /note="Description of Artificial Sequence: Synthetic oligonucleotide"
ccagagucuaaaggagugg

SEQ ID NO: 161 - RNA, 19 nt, Artificial Sequence
  source: /note="Description of Artificial Sequence: Synthetic oligonucleotide"
caccgcuuuuuauaacgcg

SEQ ID NO: 162 - RNA, 19 nt, Artificial Sequence
  source: /note="Description of Artificial Sequence: Synthetic oligonucleotide"
ccucccagauugucucgcc

SEQ ID NO: 163 - RNA, 19 nt, Artificial Sequence
  source: /note="Description of Artificial Sequence: Synthetic oligonucleotide"
cacgucuugccagaguagc

SEQ ID NO: 164 - RNA, 19 nt, Artificial Sequence
  source: /note="Description of Artificial Sequence: Synthetic oligonucleotide"
gagcaccagcaugaagagc

SEQ ID NO: 165 - RNA, 19 nt, Artificial Sequence
  source: /note="Description of Artificial Sequence: Synthetic oligonucleotide"
cacgaagaaggcgacggug

SEQ ID NO: 166 - RNA, 19 nt, Artificial Sequence
  source: /note="Description of Artificial Sequence: Synthetic oligonucleotide"
cagcgcgauggaguugccc

SEQ ID NO: 167 - RNA, 19 nt, Artificial Sequence
  source: /note="Description of Artificial Sequence: Synthetic oligonucleotide"
gagagcauguugaaggagu

SEQ ID NO: 168 - RNA, 19 nt, Artificial Sequence
  source: /note="Description of Artificial Sequence: Synthetic oligonucleotide"
cacagcgagaucaggucgg

SEQ ID NO: 169 - RNA, 19 nt, Artificial Sequence
  source: /note="Description of Artificial Sequence: Synthetic oligonucleotide"
ggugaggaagaccgcguug

SEQ ID NO: 170 - RNA, 19 nt, Artificial Sequence
  source: /note="Description of Artificial Sequence: Synthetic oligonucleotide"
cgaagauggugaagcagag

SEQ ID NO: 171 - RNA, 19 nt, Artificial Sequence
  source: /note="Description of Artificial Sequence: Synthetic oligonucleotide"
gacgccgacgaugagcacc

SEQ ID NO: 172 - RNA, 19 nt, Artificial Sequence
  source: /note="Description of Artificial Sequence: Synthetic oligonucleotide"
caccacguugaccaacagc

SEQ ID NO: 173 - RNA, 19 nt, Artificial Sequence
  source: /note="Description of Artificial Sequence: Synthetic oligonucleotide"
caguccuggaagaugagca

SEQ ID NO: 174 - RNA, 19 nt, Artificial Sequence
  source: /note="Description of Artificial Sequence: Synthetic oligonucleotide"
cagcacgcgaaccaggcgg

SEQ ID NO: 175 - RNA, 19 nt, Artificial Sequence
  source: /note="Description of Artificial Sequence: Synthetic oligonucleotide"
gcuuccuuuccaccgaggu

SEQ ID NO: 176 - RNA, 19 nt, Artificial Sequence
  source: /note="Description of Artificial Sequence: Synthetic oligonucleotide"
cuacguuugcgaacacggu

SEQ ID NO: 177 - RNA, 19 nt, Artificial Sequence
  source: /note="Description of Artificial Sequence: Synthetic oligonucleotide"
gguguugaaggaaucaccu

SEQ ID NO: 178 - RNA, 19 nt, Artificial Sequence
  source: /note="Description of Artificial Sequence: Synthetic oligonucleotide"
cuucuggcucauucugggu

SEQ ID NO: 179 - RNA, 19 nt, Artificial Sequence
  source: /note="Description of Artificial Sequence: Synthetic oligonucleotide"
uuuuucaucaugucuucug

SEQ ID NO: 180 - RNA, 19 nt, Artificial Sequence
  source: /note="Description of Artificial Sequence: Synthetic oligonucleotide"
uauucagagcuucagacuu

SEQ ID NO: 181 - RNA, 19 nt, Artificial Sequence
  source: /note="Description of Artificial Sequence: Synthetic oligonucleotide"
guacaccucugauauucag

SEQ ID NO: 182 - RNA, 19 nt, Artificial Sequence
  source: /note="Description of Artificial Sequence: Synthetic oligonucleotide"
ucacaugcaaaaguacacc

SEQ ID NO: 183 - RNA, 19 nt, Artificial Sequence
  source: /note="Description of Artificial Sequence: Synthetic oligonucleotide"
cgugaugaccacaaccacg

SEQ ID NO: 184 - RNA, 19 nt, Artificial Sequence
  source: /note="Description of Artificial Sequence: Synthetic oligonucleotide"
ggaagcacauagaauauga

SEQ ID NO: 185 - RNA, 19 nt, Artificial Sequence
  source: /note="Description of Artificial Sequence: Synthetic oligonucleotide"
ggguccucacucuucaggg

SEQ ID NO: 186 - RNA, 19 nt, Artificial Sequence
  source: /note="Description of Artificial Sequence: Synthetic oligonucleotide"
cugccaguuacacgggucc

SEQ ID NO: 187 - RNA, 19 nt, Artificial Sequence
  source: /note="Description of Artificial Sequence: Synthetic oligonucleotide"
gucaauguaacacugccag

SEQ ID NO: 188 - RNA, 19 nt, Artificial Sequence
  source: /note="Description of Artificial Sequence: Synthetic oligonucleotide"
gaugaccaugaggacaguc

SEQ ID NO: 189 - RNA, 19 nt, Artificial Sequence
  source: /note="Description of Artificial Sequence: Synthetic oligonucleotide"
ugacaaaaugaugaugacc

SEQ ID NO: 190 - RNA, 19 nt, Artificial Sequence
  source: /note="Description of Artificial Sequence: Synthetic oligonucleotide"
gcgggaaggcagaugacaa

SEQ ID NO: 191 - RNA, 19 nt, Artificial Sequence
  source: /note="Description of Artificial Sequence: Synthetic oligonucleotide"
gucuccuugauaagcggga

SEQ ID NO: 192 - RNA, 19 nt, Artificial Sequence
  source: /note="Description of Artificial Sequence: Synthetic oligonucleotide"
caucuguagcagaauggca

SEQ ID NO: 193 - RNA, 19 nt, Artificial Sequence
  source: /note="Description of Artificial Sequence: Synthetic oligonucleotide"
auguugacuccuuuuggga

SEQ ID NO: 194 - RNA, 19 nt, Artificial Sequence
  source: /note="Description of Artificial Sequence: Synthetic oligonucleotide"
caucagcucuuccauguug

SEQ ID NO: 195 - RNA, 19 nt, Artificial Sequence
  source: /note="Description of Artificial Sequence: Synthetic oligonucleotide"
agagaguuuacucaucagc

SEQ ID NO: 196 - RNA, 19 nt, Artificial Sequence
  source: /note="Description of Artificial Sequence: Synthetic oligonucleotide"
guacacugcuaauuccagg

SEQ ID NO: 197 - RNA, 19 nt, Artificial Sequence
  source: /note="Description of Artificial Sequence: Synthetic oligonucleotide"
ugugcacuucauguacacu

SEQ ID NO: 198 - RNA, 19 nt, Artificial Sequence
  source: /note="Description of Artificial Sequence: Synthetic oligonucleotide"
uacaaguucccagaugugc

SEQ ID NO: 199 - RNA, 19 nt, Artificial Sequence
  source: /note="Description of Artificial Sequence: Synthetic oligonucleotide"
uaaucuuuccacuuacaag

SEQ ID NO: 200 - RNA, 19 nt, Artificial Sequence
  source: /note="Description of Artificial Sequence: Synthetic oligonucleotide"
gcaggguggcaauaaucuu

SEQ ID NO: 201 - RNA, 19 nt, Artificial Sequence
  source: /note="Description of Artificial Sequence: Synthetic oligonucleotide"
cuguccuuaggauacuuga

SEQ ID NO: 202 - RNA, 19 nt, Artificial Sequence
  source: /note="Description of Artificial Sequence: Synthetic oligonucleotide"
gcuggcaucuugauauccc

SEQ ID NO: 203 - RNA, 19 nt, Artificial Sequence
  source: /note="Description of Artificial Sequence: Synthetic oligonucleotide"
auuucucgaauuuuugugc

SEQ ID NO: 204 - RNA, 19 nt, Artificial Sequence
  source: /note="Description of Artificial Sequence: Synthetic oligonucleotide"
gcaugguggaagauuucuc

SEQ ID NO: 205 - RNA, 19 nt, Artificial Sequence
  source: /note="Description of Artificial Sequence: Synthetic oligonucleotide"
gauggucacauuguggauu

SEQ ID NO: 206 - RNA, 19 nt, Artificial Sequence
  source: /note="Description of Artificial Sequence: Synthetic oligonucleotide"
cacauuuucaaacuggaug

SEQ ID NO: 207 - RNA, 19 nt, Artificial Sequence
  source: /note="Description of Artificial Sequence: Synthetic oligonucleotide"
gguuccuucaaguccacau

SEQ ID NO: 208 - RNA, 19 nt, Artificial Sequence
  source: /note="Description of Artificial Sequence: Synthetic oligonucleotide"
caacaguaaguccuucugc

SEQ ID NO: 209 - RNA, 19 nt, Artificial Sequence
  source: /note="Description of Artificial Sequence: Synthetic oligonucleotide"
ggugaguugcagagcaaca

SEQ ID NO: 210 - RNA, 19 nt, Artificial Sequence
  source: /note="Description of Artificial Sequence: Synthetic oligonucleotide"
ccuuggagaugcaggguga

SEQ ID NO: 211 - RNA, 19 nt, Artificial Sequence
  source: /note="Description of Artificial Sequence: Synthetic oligonucleotide"
caacacagcugcuuagcac

SEQ ID NO: 212 - RNA, 19 nt, Artificial Sequence
  source: /note="Description of Artificial Sequence: Synthetic oligonucleotide"
cacagccauugacgugagc

SEQ ID NO: 213 - RNA, 19 nt, Artificial Sequence
  source: /note="Description of Artificial Sequence: Synthetic oligonucleotide"
caccauugugcucagcaca

SEQ ID NO: 214 - RNA, 19 nt, Artificial Sequence
  source: /note="Description of Artificial Sequence: Synthetic oligonucleotide"
uuccguaugugucuagaga

SEQ ID NO: 215 - RNA, 19 nt, Artificial Sequence
  source: /note="Description of Artificial Sequence: Synthetic oligonucleotide"
cugaggccaucacuuccgu

SEQ ID NO: 216 - RNA, 19 nt, Artificial Sequence
  source: /note="Description of Artificial Sequence: Synthetic oligonucleotide"
cuugcgucucuucuacuga

SEQ ID NO: 217 - RNA, 19 nt, Artificial Sequence
  source: /note="Description of Artificial Sequence: Synthetic oligonucleotide"
auagccacuucucuugcgu

SEQ ID NO: 218 - RNA, 19 nt, Artificial Sequence
  source: /note="Description of Artificial Sequence: Synthetic oligonucleotide"
aaagacacuucaauagcca

SEQ ID NO: 219 - RNA, 19 nt, Artificial Sequence
  source: /note="Description of Artificial Sequence: Synthetic oligonucleotide"
agacagcuauccaaagaca

SEQ ID NO: 220 - RNA, 19 nt, Artificial Sequence
  source: /note="Description of Artificial Sequence: Synthetic oligonucleotide"
ccguggucacucagacagc

SEQ ID NO: 221 - RNA, 19 nt, Artificial Sequence
  source: /note="Description of Artificial Sequence: Synthetic oligonucleotide"
uuuuguuaagacuuugucc

SEQ ID NO: 222 - RNA, 19 nt, Artificial Sequence
  source: /note="Description of Artificial Sequence: Synthetic oligonucleotide"
gguccuccugaguuuuguu

SEQ ID NO: 223 - RNA, 19 nt, Artificial Sequence
  source: /note="Description of Artificial Sequence: Synthetic oligonucleotide"
uguugacauaacauugguc

SEQ ID NO: 224 - RNA, 19 nt, Artificial Sequence
  source: /note="Description of Artificial Sequence: Synthetic oligonucleotide"
uaaaaaugcguucuguuga

SEQ ID NO: 225 - RNA, 19 nt, Artificial Sequence
  source: /note="Description of Artificial Sequence: Synthetic oligonucleotide"
ugugaguaccagauuaaaa

SEQ ID NO: 226 - RNA, 19 nt, Artificial Sequence
  source: /note="Description of Artificial Sequence: Synthetic oligonucleotide"
uauggucugauuaugugag

SEQ ID NO: 227 - RNA, 19 nt, Artificial Sequence
  source: /note="Description of Artificial Sequence: Synthetic oligonucleotide"
gugccucgucuauaugguc

SEQ ID NO: 228 - RNA, 19 nt, Artificial Sequence
  source: /note="Description of Artificial Sequence: Synthetic oligonucleotide"
gcuugugguuccaaagugc

SEQ ID NO: 229 - RNA, 19 nt, Artificial Sequence
  source: /note="Description of Artificial Sequence: Synthetic oligonucleotide"
uuugugagccaagcuugug

SEQ ID NO: 230 - RNA, 19 nt, Artificial Sequence
  source: /note="Description of Artificial Sequence: Synthetic oligonucleotide"
cagaaagcucuuuuuguga

SEQ ID NO: 231 - RNA, 19 nt, Artificial Sequence
  source: /note="Description of Artificial Sequence: Synthetic oligonucleotide"
gggccuacaacccagaaag

SEQ ID NO: 232 - RNA, 19 nt, Artificial Sequence
  source: /note="Description of Artificial Sequence: Synthetic oligonucleotide"
augcugcaagucuagucug

SEQ ID NO: 233 - RNA, 19 nt, Artificial Sequence
  source: /note="Description of Artificial Sequence: Synthetic oligonucleotide"
cuagugaacacagagcaug

SEQ ID NO: 234 - RNA, 19 nt, Artificial Sequence
  source: /note="Description of Artificial Sequence: Synthetic oligonucleotide"
aaucccaaacagccaaccc

SEQ ID NO: 235 - RNA, 19 nt, Artificial Sequence
  source: /note="Description of Artificial Sequence: Synthetic oligonucleotide"
acguuuaacuaaaauccca

SEQ ID NO: 236 - RNA, 19 nt, Artificial Sequence
  source: /note="Description of Artificial Sequence: Synthetic oligonucleotide"
uaaaaauucacagacacgu

SEQ ID NO: 237 - RNA, 19 nt, Artificial Sequence
  source: /note="Description of Artificial Sequence: Synthetic oligonucleotide"
auggaaaggaguuaguuac

SEQ ID NO: 238 - RNA, 19 nt, Artificial Sequence
  source: /note="Description of Artificial Sequence: Synthetic oligonucleotide"
aagagcagcaugagacacc

SEQ ID NO: 239 - RNA, 19 nt, Artificial Sequence
  source: /note="Description of Artificial Sequence: Synthetic oligonucleotide"
cugaaacagucaaagagca

SEQ ID NO: 240 - RNA, 19 nt, Artificial Sequence
  source: /note="Description of Artificial Sequence: Synthetic oligonucleotide"
uagaaaaugcauguucaag

SEQ ID NO: 241 - RNA, 19 nt, Artificial Sequence
  source: /note="Description of Artificial Sequence: Synthetic oligonucleotide"
cuagugcaguuugcuuuag

SEQ ID NO: 242 - RNA, 19 nt, Artificial Sequence
  source: /note="Description of Artificial Sequence: Synthetic oligonucleotide"
cugauauauacacuagugc

SEQ ID NO: 243 - RNA, 19 nt, Artificial Sequence
  source: /note="Description of Artificial Sequence: Synthetic oligonucleotide"
cagacuuuaaugucccuga

SEQ ID NO: 244 - RNA, 19 nt, Artificial Sequence
  source: /note="Description of Artificial Sequence: Synthetic oligonucleotide"
guauccgcagcuauugagc

SEQ ID NO: 245 - RNA, 19 nt, Artificial Sequence
  source: /note="Description of Artificial Sequence: Synthetic oligonucleotide"
ucuuugaacacuguauccg

SEQ ID NO: 246 - RNA, 19 nt, Artificial Sequence
  source: /note="Description of Artificial Sequence: Synthetic oligonucleotide"
ucaguuuagaaacaagaac

SEQ ID NO: 247 - RNA, 19 nt, Artificial Sequence
  source: /note="Description of Artificial Sequence: Synthetic oligonucleotide"
uagaaguucuaaucaguuu

SEQ ID NO: 248 - RNA, 19 nt, Artificial Sequence
  source: /note="Description of Artificial Sequence: Synthetic oligonucleotide"
cugagcauuagcuagaagu

SEQ ID NO: 249 - RNA, 19 nt, Artificial Sequence
  source: /note="Description of Artificial Sequence: Synthetic oligonucleotide"
auguauuuaagcuaugauc

SEQ ID NO: 250 - RNA, 19 nt, Artificial Sequence
  source: /note="Description of Artificial Sequence: Synthetic oligonucleotide"
uugugguacuuuaguuuuu

SEQ ID NO: 251 - RNA, 19 nt, Artificial Sequence
  source: /note="Description of Artificial Sequence: Synthetic oligonucleotide"
aaaauacagcuauuguggu

SEQ ID NO: 252 - RNA, 19 nt, Artificial Sequence
  source: /note="Description of Artificial Sequence: Synthetic oligonucleotide"
cuuuuaugaucguuaaggg

SEQ ID NO: 253 - RNA, 19 nt, Artificial Sequence
  source: /note="Description of Artificial Sequence: Synthetic oligonucleotide"
cagaaauacuuaacuugcc

SEQ ID NO: 254 - RNA, 19 nt, Artificial Sequence
  source: /note="Description of Artificial Sequence: Synthetic oligonucleotide"
aaagauauuucuucagugc

SEQ ID NO: 255 - RNA, 19 nt, Artificial Sequence
  source: /note="Description of Artificial Sequence: Synthetic oligonucleotide"
auucaaaaaugaaucaaag

SEQ ID NO: 256 - RNA, 19 nt, Artificial Sequence
  source: /note="Description of Artificial Sequence: Synthetic oligonucleotide"
ucuaccuuaauaguuauuc

SEQ ID NO: 257 - RNA, 19 nt, Artificial Sequence
  source: /note="Description of Artificial Sequence: Synthetic oligonucleotide"
cugagaauauuuucuaccu

SEQ ID NO: 258 - RNA, 19 nt, Artificial Sequence
  source: /note="Description of Artificial Sequence: Synthetic oligonucleotide"
cucuagaauguucugagaa

SEQ ID NO: 259 - RNA, 19 nt, Artificial Sequence
  source: /note="Description of Artificial Sequence: Synthetic oligonucleotide"
uccuacuaaccuuuaccuc

SEQ ID NO: 260 - RNA, 19 nt, Artificial Sequence
  source: /note="Description of Artificial Sequence: Synthetic oligonucleotide"
ucacaaaauguagagaugg

SEQ ID NO: 261 - RNA, 19 nt, Artificial Sequence
  source: /note="Description of Artificial Sequence: Synthetic oligonucleotide"
cauuaguuuucucucaccu

SEQ ID NO: 262 - RNA, 19 nt, Artificial Sequence
  source: /note="Description of Artificial Sequence: Synthetic oligonucleotide"
cacagcagaaaguaaacau

SEQ ID NO: 263 - RNA, 19 nt, Artificial Sequence
  source: /note="Description of Artificial Sequence: Synthetic oligonucleotide"
cugcaguucaguucacagc

SEQ ID NO: 264 - RNA, 19 nt, Artificial Sequence
  source: /note="Description of Artificial Sequence: Synthetic oligonucleotide"
uugaaacauucuauagcug

SEQ ID NO: 265 - RNA, 19 nt, Artificial Sequence
  source: /note="Description of Artificial Sequence: Synthetic oligonucleotide"
auauuuaagcauuugaaac

SEQ ID NO: 266 - RNA, 19 nt, Artificial Sequence
  source: /note="Description of Artificial Sequence: Synthetic oligonucleotide"
cccucacuuccauggaaaa

SEQ ID NO: 267 - RNA, 19 nt, Artificial Sequence
  source: /note="Description of Artificial Sequence: Synthetic oligonucleotide"
ggaaacugaaauauucccu

SEQ ID NO: 268 - RNA, 19 nt, Artificial Sequence
  source: /note="Description of Artificial Sequence: Synthetic oligonucleotide"
ugugucauacuucaggaaa

SEQ ID NO: 269 - RNA, 19 nt, Artificial Sequence
  source: /note="Description of Artificial Sequence: Synthetic oligonucleotide"
uaaaagacaguauaugagu

SEQ ID NO: 270 - RNA, 19 nt, Artificial Sequence
  source: /note="Description of Artificial Sequence: Synthetic oligonucleotide"
uccaacuauacugacucua

SEQ ID NO: 271 - RNA, 19 nt, Artificial Sequence
  source: /note="Description of Artificial Sequence: Synthetic oligonucleotide"
agcacuaaaugaaaacagc

SEQ ID NO: 272 - RNA, 19 nt, Artificial Sequence
  source: /note="Description of Artificial Sequence: Synthetic oligonucleotide"
uaaaucauuaucaaagcac

SEQ ID NO: 273 - RNA, 19 nt, Artificial Sequence
  source: /note="Description of Artificial Sequence: Synthetic oligonucleotide"
uuggaaaaauaaguaaauc

SEQ ID NO: 274 - RNA, 19 nt, Artificial Sequence
  source: /note="Description of Artificial Sequence: Synthetic oligonucleotide"
aauucaaacgaaauuugga

SEQ ID NO: 275 - RNA, 19 nt, Artificial Sequence
  source: /note="Description of Artificial Sequence: Synthetic oligonucleotide"
caaugcaaucauaugaaag

SEQ ID NO: 276 - RNA, 19 nt, Artificial Sequence
  source: /note="Description of Artificial Sequence: Synthetic oligonucleotide"
ugcugcauagaucaaugca

SEQ ID NO: 277 - RNA, 19 nt, Artificial Sequence
  source: /note="Description of Artificial Sequence: Synthetic oligonucleotide"
cuuuucugguaaaugcugc

SEQ ID NO: 278 - RNA, 19 nt, Artificial Sequence
  source: /note="Description of Artificial Sequence: Synthetic oligonucleotide"
cuaucccaggaauacucuu

SEQ ID NO: 279 - RNA, 19 nt, Artificial Sequence
  source: /note="Description of Artificial Sequence: Synthetic oligonucleotide"
caguguuaugcauucugcu

SEQ ID NO: 280 - RNA, 19 nt, Artificial Sequence
  source: /note="Description of Artificial Sequence: Synthetic oligonucleotide"
aagaauuaacacucagugu

SEQ ID NO: 281 - RNA, 19 nt, Artificial Sequence
  source: /note="Description of Artificial Sequence: Synthetic oligonucleotide"
ggcagucuagcuuauuuau

SEQ ID NO: 282 - RNA, 19 nt, Artificial Sequence
  source: /note="Description of Artificial Sequence: Synthetic oligonucleotide"
uaauuaaagagaaggcagu

SEQ ID NO: 283 - RNA, 19 nt, Artificial Sequence
  source: /note="Description of Artificial Sequence: Synthetic oligonucleotide"
ugacaacuauaauaaauac

SEQ ID NO: 284 - RNA, 19 nt, Artificial Sequence
  source: /note="Description of Artificial Sequence: Synthetic oligonucleotide"
auugaguuacuaguugaca

SEQ ID NO: 285 - RNA, 19 nt, Artificial Sequence
  source: /note="Description of Artificial Sequence: Synthetic oligonucleotide"
aucaacuuuuucauugagu

SEQ ID NO: 286 - RNA, 19 nt, Artificial Sequence
  source: /note="Description of Artificial Sequence: Synthetic oligonucleotide"
auucucauuucucccuugg

SEQ ID NO: 287 - RNA, 19 nt, Artificial Sequence
  source: /note="Description of Artificial Sequence: Synthetic oligonucleotide"
gcaauuaagcuaauucuca

SEQ ID NO: 288 - RNA, 19 nt, Artificial Sequence
  source: /note="Description of Artificial Sequence: Synthetic oligonucleotide"
aaaaacacauuaaaggcag

SEQ ID NO: 289 - RNA, 19 nt, Artificial Sequence
  source: /note="Description of Artificial Sequence: Synthetic oligonucleotide"
agaaaauuuuaaguuccuc

SEQ ID NO: 290 - RNA, 19 nt, Artificial Sequence
  source: /note="Description of Artificial Sequence: Synthetic oligonucleotide"
cagcgacaugaaagaaaau

SEQ ID NO: 291 - RNA, 19 nt, Artificial Sequence
  source: /note="Description of Artificial Sequence: Synthetic oligonucleotide"
cuugguaauauggaucagc

SEQ ID NO: 292 - RNA, 19 nt, Artificial Sequence
  source: /note="Description of Artificial Sequence: Synthetic oligonucleotide"
aaauuuuauuugaacuugg

SEQ ID NO: 293 - RNA, 19 nt, Artificial Sequence
  source: /note="Description of Artificial Sequence: Synthetic oligonucleotide"
gucugaauccgauuauaaa

SEQ ID NO: 294 - RNA, 19 nt, Artificial Sequence
  source: /note="Description of Artificial Sequence: Synthetic oligonucleotide"
uuuuuaguuugguuauggg

SEQ ID NO: 295 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccacuccuuuagacucuggtt

SEQ ID NO: 296 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcguuauaaaaagcggugtt

SEQ ID NO: 297 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcgagacaaucugggaggtt

SEQ ID NO: 298 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuacucuggcaagacgugtt

SEQ ID NO: 299 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcucuucaugcuggugcuctt

SEQ ID NO: 300 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caccgucgccuucuucgugtt

SEQ ID NO: 301 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggcaacuccaucgcgcugtt

SEQ ID NO: 302 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuccuucaacaugcucuctt

SEQ ID NO: 303 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgaccugaucucgcugugtt

SEQ ID NO: 304 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caacgcggucuuccucacctt

SEQ ID NO: 305 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucugcuucaccaucuucgtt

SEQ ID NO: 306 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggugcucaucgucggcguctt

SEQ ID NO: 307 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuguuggucaacguggugtt

SEQ ID NO: 308 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcucaucuuccaggacugtt

SEQ ID NO: 309 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgccugguucgcgugcugtt

SEQ ID NO: 310 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accucgguggaaaggaagctt

SEQ ID NO: 311 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accguguucgcaaacguagtt

SEQ ID NO: 312 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggugauuccuucaacacctt

SEQ ID NO: 313 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acccagaaugagccagaagtt

SEQ ID NO: 314 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagaagacaugaugaaaaatt

SEQ ID NO: 315 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagucugaagcucugaauatt

SEQ ID NO: 316 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugaauaucagagguguactt

SEQ ID NO: 317 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gguguacuuuugcaugugatt

SEQ ID NO: 318 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgugguuguggucaucacgtt

SEQ ID NO: 319 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucauauucuaugugcuucctt

SEQ ID NO: 320 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccugaagagugaggaccctt

SEQ ID NO: 321 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggacccguguaacuggcagtt

SEQ ID NO: 322 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuggcaguguuacauugactt

SEQ ID NO: 323 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacuguccucauggucauctt

SEQ ID NO: 324 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggucaucaucauuuugucatt

SEQ ID NO: 325 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugucaucugccuucccgctt

SEQ ID NO: 326 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccgcuuaucaaggagactt

SEQ ID NO: 327 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccauucugcuacagaugtt

SEQ ID NO: 328 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccaaaaggagucaacautt

SEQ ID NO: 329 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caacauggaagagcugaugtt

SEQ ID NO: 330 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcugaugaguaaacucucutt

SEQ ID NO: 331 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuggaauuagcaguguactt

SEQ ID NO: 332 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguguacaugaagugcacatt

SEQ ID NO: 333 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcacaucugggaacuuguatt

SEQ ID NO: 334 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuguaaguggaaagauuatt

SEQ ID NO: 335 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagauuauugccacccugctt

SEQ ID NO: 336 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaaguauccuaaggacagtt

SEQ ID NO: 337 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggauaucaagaugccagctt

SEQ ID NO: 338 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcacaaaaauucgagaaautt

SEQ ID NO: 339 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagaaaucuuccaccaugctt

SEQ ID NO: 340 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauccacaaugugaccauctt

SEQ ID NO: 341 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauccaguuugaaaaugugtt

SEQ ID NO: 342 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auguggacuugaaggaacctt

SEQ ID NO: 343 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcagaaggacuuacuguugtt

SEQ ID NO: 344 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguugcucugcaacucacctt

SEQ ID NO: 345 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacccugcaucuccaaggtt

SEQ ID NO: 346 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugcuaagcagcuguguugtt

SEQ ID NO: 347 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcucacgucaauggcugugtt

SEQ ID NO: 348 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugcugagcacaauggugtt

SEQ ID NO: 349 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucuagacacauacggaatt

SEQ ID NO: 350 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acggaagugauggccucagtt

SEQ ID NO: 351 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaguagaagagacgcaagtt

SEQ ID NO: 352 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgcaagagaaguggcuautt

SEQ ID NO: 353 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggcuauugaagugucuuutt

SEQ ID NO: 354 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucuuuggauagcugucutt

SEQ ID NO: 355 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcugucugagugaccacggtt

SEQ ID NO: 356 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggacaaagucuuaacaaaatt

SEQ ID NO: 357 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacaaaacucaggaggacctt

SEQ ID NO: 358 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaccaauguuaugucaacatt

SEQ ID NO: 359 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaacagaacgcauuuuuatt

SEQ ID NO: 360 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuaaucugguacucacatt

SEQ ID NO: 361 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucacauaaucagaccauatt

SEQ ID NO: 362 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaccauauagacgaggcactt

SEQ ID NO: 363 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcacuuuggaaccacaagctt

SEQ ID NO: 364 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacaagcuuggcucacaaatt

SEQ ID NO: 365 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacaaaaagagcuuucugtt

SEQ ID NO: 366 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuucuggguuguaggccctt

SEQ ID NO: 367 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagacuagacuugcagcautt

SEQ ID NO: 368 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caugcucuguguucacuagtt

SEQ ID NO: 369 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggguuggcuguuugggauutt

SEQ ID NO: 370 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugggauuuuaguuaaacgutt

SEQ ID NO: 371 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgugucugugaauuuuuatt

SEQ ID NO: 372 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guaacuaacuccuuuccautt

SEQ ID NO: 373 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggugucucaugcugcucuutt

SEQ ID NO: 374 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcucuuugacuguuucagtt

SEQ ID NO: 375 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuugaacaugcauuuucuatt

SEQ ID NO: 376 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuaaagcaaacugcacuagtt

SEQ ID NO: 377 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcacuaguguauauaucagtt

SEQ ID NO: 378 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagggacauuaaagucugtt

SEQ ID NO: 379 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcucaauagcugcggauactt

SEQ ID NO: 380 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggauacaguguucaaagatt

SEQ ID NO: 381 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guucuuguuucuaaacugatt

SEQ ID NO: 382 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaacugauuagaacuucuatt

SEQ ID NO: 383 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuucuagcuaaugcucagtt

SEQ ID NO: 384 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaucauagcuuaaauacautt

SEQ ID NO: 385 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaaacuaaaguaccacaatt

SEQ ID NO: 386 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accacaauagcuguauuuutt

SEQ ID NO: 387 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccuuaacgaucauaaaagtt

SEQ ID NO: 388 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcaaguuaaguauuucugtt

SEQ ID NO: 389 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcacugaagaaauaucuuutt

SEQ ID NO: 390 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuugauucauuuuugaautt

SEQ ID NO: 391 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaauaacuauuaagguagatt

SEQ ID NO: 392 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agguagaaaauauucucagtt

SEQ ID NO: 393 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucucagaacauucuagagtt

SEQ ID NO: 394 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagguaaagguuaguaggatt

SEQ ID NO: 395 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaucucuacauuuugugatt

SEQ ID NO: 396 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggugagagaaaacuaaugtt

SEQ ID NO: 397 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auguuuacuuucugcugugtt

SEQ ID NO: 398 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcugugaacugaacugcagtt

SEQ ID NO: 399 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagcuauagaauguuucaatt

SEQ ID NO: 400 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuucaaaugcuuaaauautt

SEQ ID NO: 401 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuccauggaagugagggtt

SEQ ID NO: 402 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggaauauuucaguuucctt

SEQ ID NO: 403 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuccugaaguaugacacatt

SEQ ID NO: 404 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucauauacugucuuuuatt

SEQ ID NO: 405 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagagucaguauaguuggatt

SEQ ID NO: 406 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuguuuucauuuagugcutt

SEQ ID NO: 407 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugcuuugauaaugauuuatt

SEQ ID NO: 408 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauuuacuuauuuuuccaatt

SEQ ID NO: 409 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccaaauuucguuugaauutt

SEQ ID NO: 410 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuucauaugauugcauugtt

SEQ ID NO: 411 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcauugaucuaugcagcatt

SEQ ID NO: 412 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcagcauuuaccagaaaagtt

SEQ ID NO: 413 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagaguauuccugggauagtt

SEQ ID NO: 414 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcagaaugcauaacacugtt

SEQ ID NO: 415 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acacugaguguuaauucuutt

SEQ ID NO: 416 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auaaauaagcuagacugcctt

SEQ ID NO: 417 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acugccuucucuuuaauuatt

SEQ ID NO: 418 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guauuuauuauaguugucatt

SEQ ID NO: 419 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucaacuaguaacucaautt

SEQ ID NO: 420 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucaaugaaaaaguugautt

SEQ ID NO: 421 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaagggagaaaugagaautt

SEQ ID NO: 422 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagaauuagcuuaauugctt

SEQ ID NO: 423 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugccuuuaauguguuuuutt

SEQ ID NO: 424 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaggaacuuaaaauuuucutt

SEQ ID NO: 425 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuuucuuucaugucgcugtt

SEQ ID NO: 426 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcugauccauauuaccaagtt

SEQ ID NO: 427 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaaguucaaauaaaauuutt

SEQ ID NO: 428 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuauaaucggauucagactt

SEQ ID NO: 429 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccauaaccaaacuaaaaatt

SEQ ID NO: 430 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccagagucuaaaggaguggtt

SEQ ID NO: 431 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caccgcuuuuuauaacgcgtt

SEQ ID NO: 432 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccucccagauugucucgcctt

SEQ ID NO: 433 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacgucuugccagaguagctt

SEQ ID NO: 434 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagcaccagcaugaagagctt

SEQ ID NO: 435 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacgaagaaggcgacggugtt

SEQ ID NO: 436 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagcgcgauggaguugccctt

SEQ ID NO: 437 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagagcauguugaaggagutt

SEQ ID NO: 438 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacagcgagaucaggucggtt

SEQ ID NO: 439 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggugaggaagaccgcguugtt

SEQ ID NO: 440 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgaagauggugaagcagagtt

SEQ ID NO: 441 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacgccgacgaugagcacctt

SEQ ID NO: 442 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caccacguugaccaacagctt

SEQ ID NO: 443 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caguccuggaagaugagcatt

SEQ ID NO: 444 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagcacgcgaaccaggcggtt

SEQ ID NO: 445 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuuccuuuccaccgaggutt

SEQ ID NO: 446 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuacguuugcgaacacggutt

SEQ ID NO: 447 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gguguugaaggaaucaccutt

SEQ ID NO: 448 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucuggcucauucugggutt

SEQ ID NO: 449 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuucaucaugucuucugtt

SEQ ID NO: 450 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauucagagcuucagacuutt

SEQ ID NO: 451 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guacaccucugauauucagtt

SEQ ID NO: 452 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacaugcaaaaguacacctt

SEQ ID NO: 453 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgugaugaccacaaccacgtt

SEQ ID NO: 454 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaagcacauagaauaugatt

SEQ ID NO: 455 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggguccucacucuucagggtt

SEQ ID NO: 456 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugccaguuacacgggucctt

SEQ ID NO: 457 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucaauguaacacugccagtt

SEQ ID NO: 458 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaugaccaugaggacaguctt

SEQ ID NO: 459 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugacaaaaugaugaugacctt

SEQ ID NO: 460 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcgggaaggcagaugacaatt

SEQ ID NO: 461 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucuccuugauaagcgggatt

SEQ ID NO: 462 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucuguagcagaauggcatt

SEQ ID NO: 463 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auguugacuccuuuugggatt

SEQ ID NO: 464 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucagcucuuccauguugtt

SEQ ID NO: 465 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagaguuuacucaucagctt

SEQ ID NO: 466 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guacacugcuaauuccaggtt

SEQ ID NO: 467 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugcacuucauguacacutt

SEQ ID NO: 468 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacaaguucccagaugugctt

SEQ ID NO: 469 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaucuuuccacuuacaagtt

SEQ ID NO: 470 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcaggguggcaauaaucuutt

SEQ ID NO: 471 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuguccuuaggauacuugatt

SEQ ID NO: 472 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuggcaucuugauauccctt

SEQ ID NO: 473 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuucucgaauuuuugugctt

SEQ ID NO: 474 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcaugguggaagauuucuctt

SEQ ID NO: 475 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauggucacauuguggauutt

SEQ ID NO: 476 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacauuuucaaacuggaugtt

SEQ ID NO: 477 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gguuccuucaaguccacautt

SEQ ID NO: 478 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caacaguaaguccuucugctt

SEQ ID NO: 479 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggugaguugcagagcaacatt

SEQ ID NO: 480 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuuggagaugcagggugatt

SEQ ID NO: 481 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caacacagcugcuuagcactt

SEQ ID NO: 482 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacagccauugacgugagctt

SEQ ID NO: 483 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caccauugugcucagcacatt

SEQ ID NO: 484 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccguaugugucuagagatt

SEQ ID NO: 485 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugaggccaucacuuccgutt

SEQ ID NO: 486 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuugcgucucuucuacugatt

SEQ ID NO: 487 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auagccacuucucuugcgutt

SEQ ID NO: 488 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagacacuucaauagccatt

SEQ ID NO: 489 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agacagcuauccaaagacatt

SEQ ID NO: 490 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccguggucacucagacagctt

SEQ ID NO: 491 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuguuaagacuuugucctt

SEQ ID NO: 492 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gguccuccugaguuuuguutt

SEQ ID NO: 493 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguugacauaacauugguctt

SEQ ID NO: 494 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaaaaugcguucuguugatt

SEQ ID NO: 495 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugaguaccagauuaaaatt

SEQ ID NO: 496 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauggucugauuaugugagtt

SEQ ID NO: 497 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugccucgucuauaugguctt

SEQ ID NO: 498 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuugugguuccaaagugctt

SEQ ID NO: 499 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuugugagccaagcuugugtt

SEQ ID NO: 500 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagaaagcucuuuuugugatt

SEQ ID NO: 501 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggccuacaacccagaaagtt

SEQ ID NO: 502 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augcugcaagucuagucugtt

SEQ ID NO: 503 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuagugaacacagagcaugtt

SEQ ID NO: 504 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaucccaaacagccaaccctt

SEQ ID NO: 505 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acguuuaacuaaaaucccatt

SEQ ID NO: 506 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaaaauucacagacacgutt

SEQ ID NO: 507 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auggaaaggaguuaguuactt

SEQ ID NO: 508 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagagcagcaugagacacctt

SEQ ID NO: 509 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugaaacagucaaagagcatt

SEQ ID NO: 510 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagaaaaugcauguucaagtt

SEQ ID NO: 511 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuagugcaguuugcuuuagtt

SEQ ID NO: 512 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugauauauacacuagugctt

SEQ ID NO: 513 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagacuuuaaugucccugatt

SEQ ID NO: 514 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guauccgcagcuauugagctt

SEQ ID NO: 515 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuuugaacacuguauccgtt

SEQ ID NO: 516 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaguuuagaaacaagaactt

SEQ ID NO: 517 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagaaguucuaaucaguuutt

SEQ ID NO: 518 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugagcauuagcuagaagutt

SEQ ID NO: 519 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auguauuuaagcuaugauctt

SEQ ID NO: 520 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugugguacuuuaguuuuutt

SEQ ID NO: 521 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaauacagcuauuguggutt

SEQ ID NO: 522 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuuaugaucguuaagggtt

SEQ ID NO: 523 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagaaauacuuaacuugcctt

SEQ ID NO: 524 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagauauuucuucagugctt

SEQ ID NO: 525 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auucaaaaaugaaucaaagtt

SEQ ID NO: 526 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuaccuuaauaguuauuctt

SEQ ID NO: 527 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugagaauauuuucuaccutt

SEQ ID NO: 528 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucuagaauguucugagaatt

SEQ ID NO: 529 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccuacuaaccuuuaccuctt

SEQ ID NO: 530 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacaaaauguagagauggtt

SEQ ID NO: 531 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauuaguuuucucucaccutt

SEQ ID NO: 532 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacagcagaaaguaaacautt

SEQ ID NO: 533 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcaguucaguucacagctt

SEQ ID NO: 534 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugaaacauucuauagcugtt

SEQ ID NO: 535 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auauuuaagcauuugaaactt

SEQ ID NO: 536 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccucacuuccauggaaaatt

SEQ ID NO: 537 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaaacugaaauauucccutt

SEQ ID NO: 538 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugucauacuucaggaaatt

SEQ ID NO: 539 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaaagacaguauaugagutt

SEQ ID NO: 540 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccaacuauacugacucuatt

SEQ ID NO: 541 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcacuaaaugaaaacagctt

SEQ ID NO: 542 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaaucauuaucaaagcactt

SEQ ID NO: 543 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggaaaaauaaguaaauctt

SEQ ID NO: 544 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauucaaacgaaauuuggatt

SEQ ID NO: 545 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaugcaaucauaugaaagtt

SEQ ID NO: 546 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcugcauagaucaaugcatt

SEQ ID NO: 547 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuucugguaaaugcugctt

SEQ ID NO: 548 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuaucccaggaauacucuutt

SEQ ID NO: 549 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caguguuaugcauucugcutt

SEQ ID NO: 550 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagaauuaacacucagugutt

SEQ ID NO: 551 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcagucuagcuuauuuautt

SEQ ID NO: 552 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaauuaaagagaaggcagutt

SEQ ID NO: 553 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugacaacuauaauaaauactt

SEQ ID NO: 554 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auugaguuacuaguugacatt

SEQ ID NO: 555 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucaacuuuuucauugagutt

SEQ ID NO: 556 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auucucauuucucccuuggtt

SEQ ID NO: 557 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcaauuaagcuaauucucatt

SEQ ID NO: 558 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaaacacauuaaaggcagtt

SEQ ID NO: 559 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaaaauuuuaaguuccuctt

SEQ ID NO: 560 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagcgacaugaaagaaaautt

SEQ ID NO: 561 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuugguaauauggaucagctt

SEQ ID NO: 562 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaauuuuauuugaacuuggtt

SEQ ID NO: 563 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucugaauccgauuauaaatt

SEQ ID NO: 564 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuuaguuugguuaugggtt

SEQ ID NO: 565 - DNA, 19 bp, Artificial Sequence
  source: /note="Description of Artificial Sequence: Synthetic oligonucleotide"
ccactcctttagactctgg

SEQ ID NO: 566 - DNA, 19 bp, Artificial Sequence
  source: /note="Description of Artificial Sequence: Synthetic oligonucleotide"
cgcgttataaaaagcggtg

SEQ ID NO: 567 - DNA, 19 bp, Artificial Sequence
  source: /note="Description of Artificial Sequence: Synthetic oligonucleotide"
ggcgagacaatctgggagg

SEQ ID NO: 568 - DNA, 19 bp, Artificial Sequence
  source: /note="Description of Artificial Sequence: Synthetic oligonucleotide"
gctactctggcaagacgtg

SEQ ID NO: 569 - DNA, 19 bp, Artificial Sequence
  source: /note="Description of Artificial Sequence: Synthetic oligonucleotide"
gctcttcatgctggtgctc

SEQ ID NO: 570 - DNA, 19 bp, Artificial Sequence
  source: /note="Description of Artificial Sequence: Synthetic oligonucleotide"
caccgtcgccttcttcgtg

SEQ ID NO: 571 - DNA, 19 bp, Artificial Sequence
  source: /note="Description of Artificial Sequence: Synthetic oligonucleotide"
gggcaactccatcgcgctg

SEQ ID NO: 572 - DNA, 19 bp, Artificial Sequence
  source: /note="Description of Artificial Sequence: Synthetic oligonucleotide"
actccttcaacatgctctc

SEQ ID NO: 573 - DNA, 19 bp, Artificial Sequence
  source: /note="Description of Artificial Sequence: Synthetic oligonucleotide"
ccgacctgatctcgctgtg

SEQ ID NO: 574 - DNA, 19 bp, Artificial Sequence
  source: /note="Description of Artificial Sequence: Synthetic oligonucleotide"
caacgcggtcttcctcacc

SEQ ID NO: 575 - DNA, 19 bp, Artificial Sequence
  source: /note="Description of Artificial Sequence: Synthetic oligonucleotide"
ctctgcttcaccatcttcg

SEQ ID NO: 576 - DNA, 19 bp, Artificial Sequence
  source: /note="Description of Artificial Sequence: Synthetic oligonucleotide"
ggtgctcatcgtcggcgtc

SEQ ID NO: 577 - DNA, 19 bp, Artificial Sequence
  source: /note="Description of Artificial Sequence: Synthetic oligonucleotide"
gctgttggtcaacgtggtg

SEQ ID NO: 578 - DNA, 19 bp, Artificial Sequence
  source: /note="Description of Artificial Sequence: Synthetic oligonucleotide"
tgctcatcttccaggactg

SEQ ID NO: 579 - DNA, 19 bp, Artificial Sequence
  source: /note="Description of Artificial Sequence: Synthetic oligonucleotide"
ccgcctggttcgcgtgctg

SEQ ID NO: 580 - DNA, 19 bp, Artificial Sequence
  source: /note="Description of Artificial Sequence: Synthetic oligonucleotide"
acctcggtggaaaggaagc

SEQ ID NO: 581 - DNA, 19 bp, Artificial Sequence
  source: /note="Description of Artificial Sequence: Synthetic oligonucleotide"
accgtgttcgcaaacgtag

SEQ ID NO: 582 - DNA, 19 bp, Artificial Sequence
  source: /note="Description of Artificial Sequence: Synthetic oligonucleotide"
aggtgattccttcaacacc

SEQ ID NO: 583 - DNA, 19 bp, Artificial Sequence
  source: /note="Description of Artificial Sequence: Synthetic oligonucleotide"
acccagaatgagccagaag

SEQ ID NO: 584 - DNA, 19 bp, Artificial Sequence
  source: /note="Description of Artificial Sequence: Synthetic oligonucleotide"
cagaagacatgatgaaaaa

SEQ ID NO: 585 - DNA, 19 bp, Artificial Sequence
  source: /note="Description of Artificial Sequence: Synthetic oligonucleotide"
aagtctgaagctctgaata

SEQ ID NO: 586 - DNA, 19 bp, Artificial Sequence
  source: /note="Description of Artificial Sequence: Synthetic oligonucleotide"
ctgaatatcagaggtgtac

SEQ ID NO: 587 - DNA, 19 bp, Artificial Sequence
  source: /note="Description of Artificial Sequence: Synthetic oligonucleotide"
ggtgtacttttgcatgtga

SEQ ID NO: 588 - DNA, 19 bp, Artificial Sequence
  source: /note="Description of Artificial Sequence: Synthetic oligonucleotide"
cgtggttgtggtcatcacg

SEQ ID NO: 589 - DNA, 19 bp, Artificial Sequence
  source: /note="Description of Artificial Sequence: Synthetic oligonucleotide"
tcatattctatgtgcttcc

SEQ ID NO: 590 - DNA, 19 bp, Artificial Sequence
  source: /note="Description of Artificial Sequence: Synthetic oligonucleotide"
ccctgaagagtgaggaccc

SEQ ID NO: 591 - DNA, 19 bp, Artificial Sequence
  source: /note="Description of Artificial Sequence: Synthetic oligonucleotide"
ggacccgtgtaactggcag

SEQ ID NO: 592 - DNA, 19 bp, Artificial Sequence
  source: /note="Description of Artificial Sequence: Synthetic oligonucleotide"
ctggcagtgttacattgac

SEQ ID NO: 593 - DNA, 19 bp, Artificial Sequence
  source: /note="Description of Artificial Sequence: Synthetic oligonucleotide"
gactgtcctcatggtcatc

SEQ ID NO: 594 - DNA, 19 bp, Artificial Sequence
  source: /note="Description of Artificial Sequence: Synthetic oligonucleotide"
ggtcatcatcattttgtca

SEQ ID NO: 595 - DNA, 19 bp, Artificial Sequence
  source: /note="Description of Artificial Sequence: Synthetic oligonucleotide"
ttgtcatctgccttcccgc

SEQ ID NO: 596 - DNA, 19 bp, Artificial Sequence
  source: /note="Description of Artificial Sequence: Synthetic oligonucleotide"
tcccgcttatcaaggagac

SEQ ID NO: 597 - DNA, 19 bp, Artificial Sequence
  source: /note="Description of Artificial Sequence: Synthetic oligonucleotide"
tgccattctgctacagatg

SEQ ID NO: 598 - DNA, 19 bp, Artificial Sequence
  source: /note="Description of Artificial Sequence: Synthetic oligonucleotide"
tcccaaaaggagtcaacat

SEQ ID NO: 599 - DNA, 19 bp, Artificial Sequence
  source: /note="Description of Artificial Sequence: Synthetic oligonucleotide"
caacatggaagagctgatg

SEQ ID NO: 600 - DNA, 19 bp, Artificial Sequence
  source: /note="Description of Artificial Sequence: Synthetic oligonucleotide"
gctgatgagtaaactctct

SEQ ID NO: 601 - DNA, 19 bp, Artificial Sequence
  source: /note="Description of Artificial Sequence: Synthetic oligonucleotide"
cctggaattagcagtgtac

SEQ ID NO: 602 - DNA, 19 bp, Artificial Sequence
  source: /note="Description of Artificial Sequence: Synthetic oligonucleotide"
agtgtacatgaagtgcaca

SEQ ID NO: 603 - DNA, 19 bp, Artificial Sequence
  source: /note="Description of Artificial Sequence: Synthetic oligonucleotide"
gcacatctgggaacttgta

SEQ ID NO: 604 - DNA, 19 bp, Artificial Sequence
  source: /note="Description of Artificial Sequence: Synthetic oligonucleotide"
cttgtaagtggaaagatta

SEQ ID NO: 605 - DNA, 19 bp, Artificial Sequence
  source: /note="Description of Artificial Sequence: Synthetic oligonucleotide"
aagattattgccaccctgc

SEQ ID NO: 606 - DNA, 19 bp, Artificial Sequence
  source: /note="Description of Artificial Sequence: Synthetic oligonucleotide"
tcaagtatcctaaggacag

SEQ ID NO: 607 - DNA, 19 bp, Artificial Sequence
  source: /note="Description of Artificial Sequence: Synthetic oligonucleotide"
gggatatcaagatgccagc

SEQ ID NO: 608 - DNA, 19 bp, Artificial Sequence
  source: /note="Description of Artificial Sequence: Synthetic oligonucleotide"
gcacaaaaattcgagaaat

SEQ ID NO: 609 - DNA, 19 bp, Artificial Sequence
  source: /note="Description of Artificial Sequence: Synthetic oligonucleotide"
gagaaatcttccaccatgc

SEQ ID NO: 610 - DNA, 19 bp, Artificial Sequence
  source: /note="Description of Artificial Sequence: Synthetic oligonucleotide"
aatccacaatgtgaccatc

SEQ ID NO: 611 - DNA, 19 bp, Artificial Sequence
  source: /note="Description of Artificial Sequence: Synthetic oligonucleotide"
catccagtttgaaaatgtg

SEQ ID NO: 612 - DNA, 19 bp, Artificial Sequence
  source: /note="Description of Artificial Sequence: Synthetic oligonucleotide"
atgtggacttgaaggaacc

SEQ ID NO: 613 - DNA, 19 bp, Artificial Sequence
  source: /note="Description of Artificial Sequence: Synthetic oligonucleotide"
gcagaaggacttactgttg

SEQ ID NO: 614 - DNA, 19 bp, Artificial Sequence
  source: /note="Description of Artificial Sequence: Synthetic oligonucleotide"
tgttgctctgcaactcacc

SEQ ID NO: 615 - DNA, 19 bp, Artificial Sequence
  source: /note="Description of Artificial Sequence: Synthetic oligonucleotide"
tcaccctgcatctccaagg

SEQ ID NO: 616 - DNA, 19 bp, Artificial Sequence
  source: /note="Description of Artificial Sequence: Synthetic oligonucleotide"
gtgctaagcagctgtgttg

SEQ ID NO: 617 - DNA, 19 bp, Artificial Sequence
  source: /note="Description of Artificial Sequence: Synthetic oligonucleotide"
gctcacgtcaatggctgtg

SEQ ID NO: 618 - DNA, 19 bp, Artificial Sequence
  source: /note="Description of Artificial Sequence: Synthetic oligonucleotide"
tgtgctgagcacaatggtg

SEQ ID NO: 619 - DNA, 19 bp, Artificial Sequence
  source: /note="Description of Artificial Sequence: Synthetic oligonucleotide"
tctctagacacatacggaa

SEQ ID NO: 620 - DNA, 19 bp, Artificial Sequence
  source: /note="Description of Artificial Sequence: Synthetic oligonucleotide"
acggaagtgatggcctcag

SEQ ID NO: 621 - DNA, 19 bp, Artificial Sequence
  source: /note="Description of Artificial Sequence: Synthetic oligonucleotide"
tcagtagaagagacgcaag

SEQ ID NO: 622 - DNA, 19 bp, Artificial Sequence
  source: /note="Description of Artificial Sequence: Synthetic oligonucleotide"
acgcaagagaagtggctat

SEQ ID NO: 623 - DNA, 19 bp, Artificial Sequence
  source: /note="Description of Artificial Sequence: Synthetic oligonucleotide"
tggctattgaagtgtcttt

SEQ ID NO: 624 - DNA, 19 bp, Artificial Sequence
  source: /note="Description of Artificial Sequence: Synthetic oligonucleotide"
tgtctttggatagctgtct

SEQ ID NO: 625 - DNA, 19 bp, Artificial Sequence
  source: /note="Description of Artificial Sequence: Synthetic oligonucleotide"
gctgtctgagtgaccacgg

SEQ ID NO: 626 - DNA, 19 bp, Artificial Sequence
  source: /note="Description of Artificial Sequence: Synthetic oligonucleotide"
ggacaaagtcttaacaaaa

SEQ ID NO: 627 - DNA, 19 bp, Artificial Sequence
  source: /note="Description of Artificial Sequence: Synthetic oligonucleotide"
aacaaaactcaggaggacc

SEQ ID NO: 628 - DNA, 19 bp, Artificial Sequence
  source: /note="Description of Artificial Sequence: Synthetic oligonucleotide"
gaccaatgttatgtcaaca

SEQ ID NO: 629 - DNA, 19 bp, Artificial Sequence
  source: /note="Description of Artificial Sequence: Synthetic oligonucleotide"
tcaacagaacgcattttta

SEQ ID NO: 630 - DNA, 19 bp, Artificial Sequence
  source: /note="Description of Artificial Sequence: Synthetic oligonucleotide"
ttttaatctggtactcaca

SEQ ID NO: 631 - DNA, 19 bp, Artificial Sequence
  source: /note="Description of Artificial Sequence: Synthetic oligonucleotide"
ctcacataatcagaccata

SEQ ID NO: 632 - DNA, 19 bp, Artificial Sequence
  source: /note="Description of Artificial Sequence: Synthetic oligonucleotide"
gaccatatagacgaggcac

SEQ ID NO: 633 - DNA, 19 bp, Artificial Sequence
  source: /note="Description of Artificial Sequence: Synthetic oligonucleotide"
gcactttggaaccacaagc

SEQ ID NO: 634 - DNA, 19 bp, Artificial Sequence
  source: /note="Description of Artificial Sequence: Synthetic oligonucleotide"
cacaagcttggctcacaaa

SEQ ID NO: 635 - DNA, 19 bp, Artificial Sequence
  source: /note="Description of Artificial Sequence: Synthetic oligonucleotide"
tcacaaaaagagctttctg

SEQ ID NO: 636 - DNA, 19 bp, Artificial Sequence
  source: /note="Description of Artificial Sequence: Synthetic oligonucleotide"
ctttctgggttgtaggccc

SEQ ID NO: 637 - DNA, 19 bp, Artificial Sequence
  source: /note="Description of Artificial Sequence: Synthetic oligonucleotide"
cagactagacttgcagcat

SEQ ID NO: 638 - DNA, 19 bp, Artificial Sequence
  source: /note="Description of Artificial Sequence: Synthetic oligonucleotide"
catgctctgtgttcactag

SEQ ID NO: 639 - DNA, 19 bp, Artificial Sequence
  source: /note="Description of Artificial Sequence: Synthetic oligonucleotide"
gggttggctgtttgggatt

SEQ ID NO: 640 - DNA, 19 bp, Artificial Sequence
  source: /note="Description of Artificial Sequence: Synthetic oligonucleotide"
tgggattttagttaaacgt

SEQ ID NO: 641 - DNA, 19 bp, Artificial Sequence
  source: /note="Description of Artificial Sequence: Synthetic oligonucleotide"
acgtgtctgtgaattttta

SEQ ID NO: 642 - DNA, 19 bp, Artificial Sequence
  source: /note="Description of Artificial Sequence: Synthetic oligonucleotide"
gtaactaactcctttccat

SEQ ID NO: 643 - DNA, 19 bp, Artificial Sequence
  source: /note="Description of Artificial Sequence: Synthetic oligonucleotide"
ggtgtctcatgctgctctt

SEQ ID NO: 644 - DNA, 19 bp, Artificial Sequence
  source: /note="Description of Artificial Sequence: Synthetic oligonucleotide"
tgctctttgactgtttcag

SEQ ID NO: 645 - DNA, 19 bp, Artificial Sequence
  source: /note="Description of Artificial Sequence: Synthetic oligonucleotide"
cttgaacatgcattttcta

SEQ ID NO: 646 - DNA, 19 bp, Artificial Sequence
  source: /note="Description of Artificial Sequence: Synthetic oligonucleotide"
ctaaagcaaactgcactag

SEQ ID NO: 647 - DNA, 19 bp, Artificial Sequence
  source: /note="Description of Artificial Sequence: Synthetic oligonucleotide"
gcactagtgtatatatcag

SEQ ID NO: 648 - DNA, 19 bp, Artificial Sequence
  source: /note="Description of Artificial Sequence: Synthetic oligonucleotide"
tcagggacattaaagtctg

SEQ ID NO: 649 - DNA, 19 bp, Artificial Sequence
  source: /note="Description of Artificial Sequence: Synthetic oligonucleotide"
gctcaatagctgcggatac

SEQ ID NO: 650 - DNA, 19 bp, Artificial Sequence
  source: /note="Description of Artificial Sequence: Synthetic oligonucleotide"
cggatacagtgttcaaaga

SEQ ID NO: 651 - DNA, 19 bp, Artificial Sequence
  source: /note="Description of Artificial Sequence: Synthetic oligonucleotide"
gttcttgtttctaaactga

SEQ ID NO: 652 - DNA, 19 bp, Artificial Sequence
  source: /note="Description of Artificial Sequence: Synthetic oligonucleotide"
aaactgattagaacttcta

SEQ ID NO: 653 - DNA, 19 bp, Artificial Sequence
  source: /note="Description of Artificial Sequence: Synthetic oligonucleotide"
acttctagctaatgctcag

SEQ ID NO: 654 - DNA, 19 bp, Artificial Sequence
  source: /note="Description of Artificial Sequence: Synthetic oligonucleotide"
gatcatagcttaaatacat

SEQ ID NO: 655 - DNA, 19 bp, Artificial Sequence
  source: /note="Description of Artificial Sequence: Synthetic oligonucleotide"
aaaaactaaagtaccacaa

SEQ ID NO: 656 - DNA, 19 bp, Artificial Sequence
  source: /note="Description of Artificial Sequence: Synthetic oligonucleotide"
accacaatagctgtatttt

SEQ ID NO: 657 - DNA, 19 bp, Artificial Sequence
  source: /note="Description of Artificial Sequence: Synthetic oligonucleotide"
cccttaacgatcataaaag

SEQ ID NO: 658 - DNA, 19 bp, Artificial Sequence
  source: /note="Description of Artificial Sequence: Synthetic oligonucleotide"
ggcaagttaagtatttctg

SEQ ID NO: 659 - DNA, 19 bp, Artificial Sequence
  source: /note="Description of Artificial Sequence: Synthetic oligonucleotide"
gcactgaagaaatatcttt

SEQ ID NO: 660 - DNA, 19 bp, Artificial Sequence
  source: /note="Description of Artificial Sequence: Synthetic oligonucleotide"
ctttgattcatttttgaat

SEQ ID NO: 661 - DNA, 19 bp, Artificial Sequence
  source: /note="Description of Artificial Sequence: Synthetic oligonucleotide"
gaataactattaaggtaga

SEQ ID NO: 662 - DNA, 19 bp, Artificial Sequence
  source: /note="Description of Artificial Sequence: Synthetic oligonucleotide"
aggtagaaaatattctcag

SEQ ID NO: 663 - DNA, 19 bp, Artificial Sequence
  source: /note="Description of Artificial Sequence: Synthetic oligonucleotide"
ttctcagaacattctagag

SEQ ID NO: 664 - DNA, 19 bp, Artificial Sequence
  source: /note="Description of Artificial Sequence: Synthetic oligonucleotide"
gaggtaaaggttagtagga

SEQ ID NO: 665 - DNA, 19 bp, Artificial Sequence
  source: /note="Description of Artificial Sequence: Synthetic oligonucleotide"
ccatctctacattttgtga

SEQ ID NO: 666 - DNA, 19 bp, Artificial Sequence
  source: /note="Description of Artificial Sequence: Synthetic oligonucleotide"
aggtgagagaaaactaatg

SEQ ID NO: 667 - DNA, 19 bp, Artificial Sequence
  source: /note="Description of Artificial Sequence: Synthetic oligonucleotide"
atgtttactttctgctgtg

SEQ ID NO: 668 - DNA, 19 bp, Artificial Sequence
  source: /note="Description of Artificial Sequence: Synthetic oligonucleotide"
gctgtgaactgaactgcag

SEQ ID NO: 669 - DNA, 19 bp, Artificial Sequence
  source: /note="Description of Artificial Sequence: Synthetic oligonucleotide"
cagctatagaatgtttcaa

SEQ ID NO: 670 - DNA, 19 bp, Artificial Sequence
  source: /note="Description of Artificial Sequence: Synthetic oligonucleotide"
gtttcaaatgcttaaatat

SEQ ID NO: 671 - DNA, 19 bp, Artificial Sequence
  source: /note="Description of Artificial Sequence: Synthetic oligonucleotide"
ttttccatggaagtgaggg

SEQ ID NO: 672 - DNA, 19 bp, Artificial Sequence
  source: /note="Description of Artificial Sequence: Synthetic oligonucleotide"
agggaatatttcagtttcc

SEQ ID NO: 673 - DNA, 19 bp, Artificial Sequence
  source: /note="Description of Artificial Sequence: Synthetic oligonucleotide"
tttcctgaagtatgacaca

SEQ ID NO: 674 - DNA, 19 bp, Artificial Sequence
  source: /note="Description of Artificial Sequence: Synthetic oligonucleotide"
actcatatactgtctttta

SEQ ID NO: 675 - DNA, 19 bp, Artificial Sequence
  source: /note="Description of Artificial Sequence: Synthetic oligonucleotide"
tagagtcagtatagttgga

SEQ ID NO: 676 - DNA, 19 bp, Artificial Sequence
  source: /note="Description of Artificial Sequence: Synthetic oligonucleotide"
gctgttttcatttagtgct

SEQ ID NO: 677 - DNA, 19 bp, Artificial Sequence
  source: /note="Description of Artificial Sequence: Synthetic oligonucleotide"
gtgctttgataatgattta

SEQ ID NO: 678 - DNA, 19 bp, Artificial Sequence
  source: /note="Description of Artificial Sequence: Synthetic oligonucleotide"
gatttacttatttttccaa

SEQ ID NO: 679 - DNA, 19 bp, Artificial Sequence
  source: /note="Description of Artificial Sequence: Synthetic oligonucleotide"
tccaaatttcgtttgaatt

SEQ ID NO: 680 - DNA, 19 bp, Artificial Sequence
  source: /note="Description of Artificial Sequence: Synthetic oligonucleotide"
ctttcatatgattgcattg

SEQ ID NO: 681 - DNA, 19 bp, Artificial Sequence
  source: /note="Description of Artificial Sequence: Synthetic oligonucleotide"
tgcattgatctatgcagca

SEQ ID NO: 682 - DNA, 19 bp, Artificial Sequence
  source: /note="Description of Artificial Sequence: Synthetic oligonucleotide"
gcagcatttaccagaaaag

SEQ ID NO: 683 - DNA, 19 bp, Artificial Sequence
  source: /note="Description of Artificial Sequence: Synthetic oligonucleotide"
aagagtattcctgggatag

SEQ ID NO: 684 - DNA, 19 bp, Artificial Sequence
  source: /note="Description of Artificial Sequence: Synthetic oligonucleotide"
agcagaatgcataacactg

SEQ ID NO: 685 - DNA, 19 bp, Artificial Sequence
  source: /note="Description of Artificial Sequence: Synthetic oligonucleotide"
acactgagtgttaattctt

SEQ ID NO: 686 - DNA, 19 bp, Artificial Sequence
  source: /note="Description of Artificial Sequence: Synthetic oligonucleotide"
ataaataagctagactgcc

SEQ ID NO: 687 - DNA, 19 bp, Artificial Sequence
  source: /note="Description of Artificial Sequence: Synthetic oligonucleotide"
actgccttctctttaatta

SEQ ID NO: 688 - DNA, 19 bp, Artificial Sequence
  source: /note="Description of Artificial Sequence: Synthetic oligonucleotide"
gtatttattatagttgtca

SEQ ID NO: 689 - DNA, 19 bp, Artificial Sequence
  source: /note="Description of Artificial Sequence: Synthetic oligonucleotide"
tgtcaactagtaactcaat

SEQ ID NO: 690 - DNA, 19 bp, Artificial Sequence
  source: /note="Description of Artificial Sequence: Synthetic oligonucleotide"
actcaatgaaaaagttgat

SEQ ID NO: 691 - DNA, 19 bp, Artificial Sequence
  source: /note="Description of Artificial Sequence: Synthetic oligonucleotide"
ccaagggagaaatgagaat

SEQ ID NO: 692 - DNA, 19 bp, Artificial Sequence
  source: /note="Description of Artificial Sequence: Synthetic oligonucleotide"
tgagaattagcttaattgc

SEQ ID NO: 693 - DNA, 19 bp, Artificial Sequence
  source: /note="Description of Artificial Sequence: Synthetic oligonucleotide"
ctgcctttaatgtgttttt

SEQ ID NO: 694 - DNA, 19 bp, Artificial Sequence
  source: /note="Description of Artificial Sequence: Synthetic oligonucleotide"
gaggaacttaaaattttct

SEQ ID NO: 695 - DNA, 19 bp, Artificial Sequence
  source: /note="Description of Artificial Sequence: Synthetic oligonucleotide"
attttctttcatgtcgctg

SEQ ID NO: 696 - DNA, 19 bp, Artificial Sequence
  source: /note="Description of Artificial Sequence: Synthetic oligonucleotide"
gctgatccatattaccaag

SEQ ID NO: 697 - DNA, 19 bp, Artificial Sequence
  source: /note="Description of Artificial Sequence: Synthetic oligonucleotide"
ccaagttcaaataaaattt

SEQ ID NO: 698 - DNA, 19 bp, Artificial Sequence
  source: /note="Description of Artificial Sequence: Synthetic oligonucleotide"
tttataatcggattcagac

SEQ ID NO: 699 - DNA, 19 bp, Artificial Sequence
  source: /note="Description of Artificial Sequence: Synthetic oligonucleotide"
cccataaccaaactaaaaa

SEQ ID NO: 700 - RNA, 19 nt, Artificial Sequence
  source: /note="Description of Artificial Sequence: Synthetic oligonucleotide"
ccugucagagauacagagg

SEQ ID NO: 701 - RNA, 19 nt, Artificial Sequence
  source: /note="Description of Artificial Sequence: Synthetic oligonucleotide"
cagaaagagagagagaucc

SEQ ID NO: 702 - RNA, 19 nt, Artificial Sequence
  source: /note="Description of Artificial Sequence: Synthetic oligonucleotide"
cgagucuuacguugacacg

SEQ ID NO: 703 - RNA, 19 nt, Artificial Sequence
  source: /note="Description of Artificial Sequence: Synthetic oligonucleotide"
acgcagagagaaagacgca

SEQ ID NO: 704 - RNA, 19 nt, Artificial Sequence
  source: /note="Description of Artificial Sequence: Synthetic oligonucleotide"
gcagagacagacaaacaaa

SEQ ID NO: 705 - RNA, 19 nt, Artificial Sequence
  source: /note="Description of Artificial Sequence: Synthetic oligonucleotide"
aaacagauaggagaggcuc

SEQ ID NO: 706 - RNA, 19 nt, Artificial Sequence
  source: /note="Description of Artificial Sequence: Synthetic oligonucleotide"
cuacgcugccacuucaaug

SEQ ID NO: 707 - RNA, 19 nt, Artificial Sequence
  source: /note="Description of Artificial Sequence: Synthetic oligonucleotide"
agcugcuguucuuucgaag

SEQ ID NO: 708 - RNA, 19 nt, Artificial Sequence
  source: /note="Description of Artificial Sequence: Synthetic oligonucleotide"
gggcuagccuucagcgagg

SEQ ID NO: 709 - RNA, 19 nt, Artificial Sequence
  source: /note="Description of Artificial Sequence: Synthetic oligonucleotide"
ggaugugcugagcguguuc

SEQ ID NO: 710 - RNA, 19 nt, Artificial Sequence
  source: /note="Description of Artificial Sequence: Synthetic oligonucleotide"
ccagcacuugcuggagcag

SEQ ID NO: 711 - RNA, 19 nt, Artificial Sequence
  source: /note="Description of Artificial Sequence: Synthetic oligonucleotide"
cuucaaccaguguuuaacu

SEQ ID NO: 712 - RNA, 19 nt, Artificial Sequence
  source: /note="Description of Artificial Sequence: Synthetic oligonucleotide"
agaucuuuucccuucaugg

SEQ ID NO: 713 - RNA, 19 nt, Artificial Sequence
  source: /note="Description of Artificial Sequence: Synthetic oligonucleotide"
uggcuuuucaaaugcuacc

SEQ ID NO: 714 - RNA, 19 nt, Artificial Sequence
  source: /note="Description of Artificial Sequence: Synthetic oligonucleotide"
cccaaauaaccagcuccaa

SEQ ID NO: 715 - RNA, 19 nt, Artificial Sequence
  source: /note="Description of Artificial Sequence: Synthetic oligonucleotide"
ccaaauucucugucaucug

SEQ ID NO: 716 - RNA, 19 nt, Artificial Sequence
  source: /note="Description of Artificial Sequence: Synthetic oligonucleotide"
agucuuacagcaauugaac

SEQ ID NO: 717 - RNA, 19 nt, Artificial Sequence
  source: /note="Description of Artificial Sequence: Synthetic oligonucleotide"
gaacuuucacccaugugag

SEQ ID NO: 718 - RNA, 19 nt, Artificial Sequence
  source: /note="Description of Artificial Sequence: Synthetic oligonucleotide"
ggcccaagcacaaaacaag

SEQ ID NO: 719 - RNA, 19 nt, Artificial Sequence
  source: /note="Description of Artificial Sequence: Synthetic oligonucleotide"
agaccaagucauucagaag

SEQ ID NO: 720 - RNA, 19 nt, Artificial Sequence
  source: /note="Description of Artificial Sequence: Synthetic oligonucleotide"
uccugucagugacgauuau

SEQ ID NO: 721 - RNA, 19 nt, Artificial Sequence
  source: /note="Description of Artificial Sequence: Synthetic oligonucleotide"
uauuaaucuggcaucucuc

SEQ ID NO: 722 - RNA, 19 nt, Artificial Sequence
  source: /note="Description of Artificial Sequence: Synthetic oligonucleotide"
ucggauugauuuugacucc

SEQ ID NO: 723 - RNA, 19 nt, Artificial Sequence
  source: /note="Description of Artificial Sequence: Synthetic oligonucleotide"
ccacugauaaagaaaucuu

SEQ ID NO: 724 - RNA, 19 nt, Artificial Sequence
  source: /note="Description of Artificial Sequence: Synthetic oligonucleotide"
ucccaaagauuuugaccuu

SEQ ID NO: 725 - RNA, 19 nt, Artificial Sequence
  source: /note="Description of Artificial Sequence: Synthetic oligonucleotide"
ggcuauugggacucuuuuu

SEQ ID NO: 726 - RNA, 19 nt, Artificial Sequence
  source: /note="Description of Artificial Sequence: Synthetic oligonucleotide"
gcaauuuuccaacuuauuc

SEQ ID NO: 727 - RNA, 19 nt, Artificial Sequence
  source: /note="Description of Artificial Sequence: Synthetic oligonucleotide"
aggcauuuggauuugaucc

SEQ ID NO: 728 - RNA, 19 nt, Artificial Sequence
  source: /note="Description of Artificial Sequence: Synthetic oligonucleotide"
aucccaaagucgacaguua

SEQ ID NO: 729 - RNA, 19 nt, Artificial Sequence
  source: /note="Description of Artificial Sequence: Synthetic oligonucleotide"
gcaguugcuguguuuggug

SEQ ID NO: 730 - RNA, 19 nt, Artificial Sequence
  source: /note="Description of Artificial Sequence: Synthetic oligonucleotide"
guggauuuuaccuacuuuu

SEQ ID NO: 731 - RNA, 19 nt, Artificial Sequence
  source: /note="Description of Artificial Sequence: Synthetic oligonucleotide"
ugcuaaagauguuauuaaa

SEQ ID NO: 732 - RNA, 19 nt, Artificial Sequence
  source: /note="Description of Artificial Sequence: Synthetic oligonucleotide"
ggucagaauggucauaccc

SEQ ID NO: 733 - RNA, 19 nt, Artificial Sequence
  source: /note="Description of Artificial Sequence: Synthetic oligonucleotide"
ccacuuuggaaaugauaac

SEQ ID NO: 734 - RNA, 19 nt, Artificial Sequence
  source: /note="Description of Artificial Sequence: Synthetic oligonucleotide"
cuuugguccucaagaaaaa

SEQ ID NO: 735 - RNA, 19 nt, Artificial Sequence
  source: /note="Description of Artificial Sequence: Synthetic oligonucleotide"
cucaucaaccuaaagcauu

SEQ ID NO: 736 - RNA, 19 nt, Artificial Sequence
  source: /note="Description of Artificial Sequence: Synthetic oligonucleotide"
ccaucaauggugugacaug

SEQ ID NO: 737 - RNA, 19 nt, Artificial Sequence
  source: /note="Description of Artificial Sequence: Synthetic oligonucleotide"
caugcuaugcaaauccugc

SEQ ID NO: 738 - RNA, 19 nt, Artificial Sequence
  source: /note="Description of Artificial Sequence: Synthetic oligonucleotide"
gcugucacagaagcuaaug

SEQ ID NO: 739 - RNA, 19 nt, Artificial Sequence
  source: /note="Description of Artificial Sequence: Synthetic oligonucleotide"
ggacauauccauuuugaua

SEQ ID NO: 740 - RNA, 19 nt, Artificial Sequence
  source: /note="Description of Artificial Sequence: Synthetic oligonucleotide"
aaugucagugugguaucuc

SEQ ID NO: 741 - RNA, 19 nt, Artificial Sequence
  source: /note="Description of Artificial Sequence: Synthetic oligonucleotide"
ucucuacaggauggaaaaa

SEQ ID NO: 742 - RNA, 19 nt, Artificial Sequence
  source: /note="Description of Artificial Sequence: Synthetic oligonucleotide"
caaguucauguaccuguuu

SEQ ID NO: 743 - RNA, 19 nt, Artificial Sequence
  source: /note="Description of Artificial Sequence: Synthetic oligonucleotide"
gcccaaacugucagaaaua

SEQ ID NO: 744 - RNA, 19 nt, Artificial Sequence
  source: /note="Description of Artificial Sequence: Synthetic oligonucleotide"
ccuggaugauaacgcucug

SEQ ID NO: 745 - RNA, 19 nt, Artificial Sequence
  source: /note="Description of Artificial Sequence: Synthetic oligonucleotide"
cuccacaauuucaucgaug

SEQ ID NO: 746 - RNA, 19 nt, Artificial Sequence
  source: /note="Description of Artificial Sequence: Synthetic oligonucleotide"
caccuugucucuccuucag

SEQ ID NO: 747 - RNA, 19 nt, Artificial Sequence
  source: /note="Description of Artificial Sequence: Synthetic oligonucleotide"
gacucaguacuuccauagc

SEQ ID NO: 748 - RNA, 19 nt, Artificial Sequence
  source: /note="Description of Artificial Sequence: Synthetic oligonucleotide"
uccuaugugaggaguuucc

SEQ ID NO: 749 - RNA, 19 nt, Artificial Sequence
  source: /note="Description of Artificial Sequence: Synthetic oligonucleotide"
ccacgaguuaggagacuuu

SEQ ID NO: 750 - RNA, 19 nt, Artificial Sequence
  source: /note="Description of Artificial Sequence: Synthetic oligonucleotide"
cuuugugauccuacucaau

SEQ ID NO: 751 - RNA, 19 nt, Artificial Sequence
  source: /note="Description of Artificial Sequence: Synthetic oligonucleotide"
ggaugagcacucgacaagc

SEQ ID NO: 752 - RNA, 19 nt, Artificial Sequence
  source: /note="Description of Artificial Sequence: Synthetic oligonucleotide"
agccuugcuauucaacuuc

SEQ ID NO: 753 - RNA, 19 nt, Artificial Sequence
  source: /note="Description of Artificial Sequence: Synthetic oligonucleotide"
cuuccuuucugcauguucc

SEQ ID NO: 754 - RNA, 19 nt, Artificial Sequence
  source: /note="Description of Artificial Sequence: Synthetic oligonucleotide"
uuccugcuauguugggcua

SEQ ID NO: 755 - RNA, 19 nt, Artificial Sequence
  source: /note="Description of Artificial Sequence: Synthetic oligonucleotide"
gcuagcuuuuggcauuuug

SEQ ID NO: 756 - RNA, 19 nt, Artificial Sequence
  source: /note="Description of Artificial Sequence: Synthetic oligonucleotide"
caacaauuucgcuccaaau

SEQ ID NO: 757 - RNA, 19 nt, Artificial Sequence
  source: /note="Description of Artificial Sequence: Synthetic oligonucleotide"
uuauauuugcacuugcugg

SEQ ID NO: 758 - RNA, 19 nt, Artificial Sequence
  source: /note="Description of Artificial Sequence: Synthetic oligonucleotide"
cauguuccucuauauuucu

SEQ ID NO: 759 - RNA, 19 nt, Artificial Sequence
  source: /note="Description of Artificial Sequence: Synthetic oligonucleotide"
cucuggcagauauguuucc

SEQ ID NO: 760 - RNA, 19 nt, Artificial Sequence
  source: /note="Description of Artificial Sequence: Synthetic oligonucleotide"
uccagagaugaaugauaug

SEQ ID NO: 761 - RNA, 19 nt, Artificial Sequence
  source: /note="Description of Artificial Sequence: Synthetic oligonucleotide"
uaugcugagagaaaaggua

SEQ ID NO: 762 - RNA, 19 nt, Artificial Sequence
  source: /note="Description of Artificial Sequence: Synthetic oligonucleotide"
guaacuggaagaaaaaccg

SEQ ID NO: 763 - RNA, 19 nt, Artificial Sequence
  source: /note="Description of Artificial Sequence: Synthetic oligonucleotide"
accgauuucaccuucuuca

SEQ ID NO: 764 - RNA, 19 nt, Artificial Sequence
  source: /note="Description of Artificial Sequence: Synthetic oligonucleotide"
aaugcuggaauguuaacug

SEQ ID NO: 765 - RNA, 19 nt, Artificial Sequence
  source: /note="Description of Artificial Sequence: Synthetic oligonucleotide"
cauucuacucauuaccuug

SEQ ID NO: 766 - RNA, 19 nt, Artificial Sequence
  source: /note="Description of Artificial Sequence: Synthetic oligonucleotide"
cuuguaugcaggagaaauc

SEQ ID NO: 767 - RNA, 19 nt, Artificial Sequence
  source: /note="Description of Artificial Sequence: Synthetic oligonucleotide"
auuggaguaauagaaaaug

SEQ ID NO: 768 - RNA, 19 nt, Artificial Sequence
  source: /note="Description of Artificial Sequence: Synthetic oligonucleotide"
augguguuguuaauaaagg

SEQ ID NO: 769 - RNA, 19 nt, Artificial Sequence
  source: /note="Description of Artificial Sequence: Synthetic oligonucleotide"
aggcauuuaauagauaaaa

SEQ ID NO: 770 - RNA, 19 nt, Artificial Sequence
  source: /note="Description of Artificial Sequence: Synthetic oligonucleotide"
caucuccaaaaaggauuuu

SEQ ID NO: 771 - RNA, 19 nt, Artificial Sequence
  source: /note="Description of Artificial Sequence: Synthetic oligonucleotide"
cugauccuauuuaguuaaa

SEQ ID NO: 772 - RNA, 19 nt, Artificial Sequence
  source: /note="Description of Artificial Sequence: Synthetic oligonucleotide"
ugcuuucaacuguaggucc

SEQ ID NO: 773 - RNA, 19 nt, Artificial Sequence
  source: /note="Description of Artificial Sequence: Synthetic oligonucleotide"
guccagaaaacuaauuauu

SEQ ID NO: 774 - RNA, 19 nt, Artificial Sequence
  source: /note="Description of Artificial Sequence: Synthetic oligonucleotide"
ucagucugugaaauagucc

SEQ ID NO: 775 - RNA, 19 nt, Artificial Sequence
  source: /note="Description of Artificial Sequence: Synthetic oligonucleotide"
guccauuauuuguuguuaa

SEQ ID NO: 776 - RNA, 19 nt, Artificial Sequence
  source: /note="Description of Artificial Sequence: Synthetic oligonucleotide"
uuaaaaaugcuucaaaagg

SEQ ID NO: 777 - RNA, 19 nt, Artificial Sequence
  source: /note="Description of Artificial Sequence: Synthetic oligonucleotide"
gguuuucagugucagucug

SEQ ID NO: 778 - RNA, 19 nt, Artificial Sequence
  source: /note="Description of Artificial Sequence: Synthetic oligonucleotide"
ugguauauaggagccuuug

SEQ ID NO: 779 - RNA, 19 nt, Artificial Sequence
  source: /note="Description of Artificial Sequence: Synthetic oligonucleotide"
gggaaauaccuauuuuuca

SEQ ID NO: 780 - RNA, 19 nt, Artificial Sequence
  source: /note="Description of Artificial Sequence: Synthetic oligonucleotide"
ucaguauuccaugcauauu

SEQ ID NO: 781 - RNA, 19 nt, Artificial Sequence
  source: /note="Description of Artificial Sequence: Synthetic oligonucleotide"
caccaugaagcaagagaca

SEQ ID NO: 782 - RNA, 19 nt, Artificial Sequence
  source: /note="Description of Artificial Sequence: Synthetic oligonucleotide"
gacaugcauucuauaauca

SEQ ID NO: 783 - RNA, 19 nt, Artificial Sequence
  source: /note="Description of Artificial Sequence: Synthetic oligonucleotide"
uguagacacucagacucag

SEQ ID NO: 784 - RNA, 19 nt, Artificial Sequence
  source: /note="Description of Artificial Sequence: Synthetic oligonucleotide"
gggaaaauacaaguuauau

SEQ ID NO: 785 - RNA, 19 nt, Artificial Sequence
  source: /note="Description of Artificial Sequence: Synthetic oligonucleotide"
cugaaagccuuuaaaacuc

SEQ ID NO: 786 - RNA, 19 nt, Artificial Sequence
  source: /note="Description of Artificial Sequence: Synthetic oligonucleotide"
ugguaggaucaaagauuca

SEQ ID NO: 787 - RNA, 19 nt, Artificial Sequence
  source: /note="Description of Artificial Sequence: Synthetic oligonucleotide"
uucaaaugguuucagagag

SEQ ID NO: 788 - RNA, 19 nt, Artificial Sequence
  source: /note="Description of Artificial Sequence: Synthetic oligonucleotide"
gagguuuuauuucaauuaa

SEQ ID NO: 789 - RNA, 19 nt, Artificial Sequence
  source: /note="Description of Artificial Sequence: Synthetic oligonucleotide"
uguucuagugcuuucaaga

SEQ ID NO: 790 - RNA, 19 nt, Artificial Sequence
  source: /note="Description of Artificial Sequence: Synthetic oligonucleotide"
gagcaaguacaucaaaaug

SEQ ID NO: 791 - RNA, 19 nt, Artificial Sequence
  source: /note="Description of Artificial Sequence: Synthetic oligonucleotide"
guagaagguaaaauguaug

SEQ ID NO: 792 - RNA, 19 nt, Artificial Sequence
  source: /note="Description of Artificial Sequence: Synthetic oligonucleotide"
gcaacacuaauauaaauua

SEQ ID NO: 793 - RNA, 19 nt, Artificial Sequence
  source: /note="Description of Artificial Sequence: Synthetic oligonucleotide"
auuccaagucuuuaaggag

SEQ ID NO: 794 - RNA, 19 nt, Artificial Sequence
  source: /note="Description of Artificial Sequence: Synthetic oligonucleotide"
uucucacagcuuuuuguuc

SEQ ID NO: 795 - RNA, 19 nt, Artificial Sequence
  source: /note="Description of Artificial Sequence: Synthetic oligonucleotide"
ucuguuuuguauuucaauu

SEQ ID NO: 796 - RNA, 19 nt, Artificial Sequence
  source: /note="Description of Artificial Sequence: Synthetic oligonucleotide"
gaacuugcaguauuauuuu

SEQ ID NO: 797 - RNA, 19 nt, Artificial Sequence
  source: /note="Description of Artificial Sequence: Synthetic oligonucleotide"
accauucuaaaauaauagg

SEQ ID NO: 798 - RNA, 19 nt, Artificial Sequence
  source: /note="Description of Artificial Sequence: Synthetic oligonucleotide"
ggaguuaggaaauaaauaa

SEQ ID NO: 799 - RNA, 19 nt, Artificial Sequence
  source: /note="Description of Artificial Sequence: Synthetic oligonucleotide"
uaaaguuuugcuagcccug

SEQ ID NO: 800 - RNA, 19 nt, Artificial Sequence
  source: /note="Description of Artificial Sequence: Synthetic oligonucleotide"
cugcuaaguucaggcuuag

SEQ ID NO: 801 - RNA, 19 nt, Artificial Sequence
  source: /note="Description of Artificial Sequence: Synthetic oligonucleotide"
cgcuaaguauaaacuucac

SEQ ID NO: 802 - RNA, 19 nt, Artificial Sequence
  source: /note="Description of Artificial Sequence: Synthetic oligonucleotide"
caccagauuccacgaaaag

SEQ ID NO: 803 - RNA, 19 nt, Artificial Sequence
  source: /note="Description of Artificial Sequence: Synthetic oligonucleotide"
cugacuuauguugugguug

SEQ ID NO: 804 - RNA, 19 nt, Artificial Sequence
  source: /note="Description of Artificial Sequence: Synthetic oligonucleotide"
cucacaaauggcagaacag

SEQ ID NO: 805 - RNA, 19 nt, Artificial Sequence
  source: /note="Description of Artificial Sequence: Synthetic oligonucleotide"
guauguaaagcugguaaca

SEQ ID NO: 806 - RNA, 19 nt, Artificial Sequence
  source: /note="Description of Artificial Sequence: Synthetic oligonucleotide"
aacaccucgguuucagugc

SEQ ID NO: 807 - RNA, 19 nt, Artificial Sequence
  source: /note="Description of Artificial Sequence: Synthetic oligonucleotide"
gcaccauguguuugcuuug

SEQ ID NO: 808 - RNA, 19 nt, Artificial Sequence
  source: /note="Description of Artificial Sequence: Synthetic oligonucleotide"
gaaggugaagaauauguug

SEQ ID NO: 809 - RNA, 19 nt, Artificial Sequence
  source: /note="Description of Artificial Sequence: Synthetic oligonucleotide"
gguuuagagaaagaaauug

SEQ ID NO: 810 - RNA, 19 nt, Artificial Sequence
  source: /note="Description of Artificial Sequence: Synthetic oligonucleotide"
auuggauguaauuuuaugc

SEQ ID NO: 811 - RNA, 19 nt, Artificial Sequence
  source: /note="Description of Artificial Sequence: Synthetic oligonucleotide"
ugcaauuuacuuuuaaaga

SEQ ID NO: 812 - RNA, 19 nt, Artificial Sequence
  source: /note="Description of Artificial Sequence: Synthetic oligonucleotide"
gacaaacauaacuauuuag

SEQ ID NO: 813 - RNA, 19 nt, Artificial Sequence
  source: /note="Description of Artificial Sequence: Synthetic oligonucleotide"
gcagagaauauuuuaauaa

SEQ ID NO: 814 - RNA, 19 nt, Artificial Sequence
  source: /note="Description of Artificial Sequence: Synthetic oligonucleotide"
ugcaaaacaacagcuggac

SEQ ID NO: 815 - RNA, 19 nt, Artificial Sequence
  source: /note="Description of Artificial Sequence: Synthetic oligonucleotide"
acugcuguacaucaaggac

SEQ ID NO: 816 - RNA, 19 nt, Artificial Sequence
  source: /note="Description of Artificial Sequence: Synthetic oligonucleotide"
gacagauuaacuggaaaac

SEQ ID NO: 817 - RNA, 19 nt, Artificial Sequence
  source: /note="Description of Artificial Sequence: Synthetic oligonucleotide"
guuccuuaugugugaucga

SEQ ID NO: 818 - RNA, 19 nt, Artificial Sequence
  source: /note="Description of Artificial Sequence: Synthetic oligonucleotide"
ucagaaaagacuuccuuug

SEQ ID NO: 819 - RNA, 19 nt, Artificial Sequence
  source: /note="Description of Artificial Sequence: Synthetic oligonucleotide"
gccuauacuuuuccauaug

SEQ ID NO: 820 - RNA, 19 nt, Artificial Sequence
  source: /note="Description of Artificial Sequence: Synthetic oligonucleotide"
uaugguauaccuugaaaaa

SEQ ID NO: 821 - RNA, 19 nt, Artificial Sequence
  source: /note="Description of Artificial Sequence: Synthetic oligonucleotide"
acaccaugguuauuuuucu

SEQ ID NO: 822 - RNA, 19 nt, Artificial Sequence
  source: /note="Description of Artificial Sequence: Synthetic oligonucleotide"
cuaccuuuuauaaaagaca

SEQ ID NO: 823 - RNA, 19 nt, Artificial Sequence
  source: /note="Description of Artificial Sequence: Synthetic oligonucleotide"
ccuguuuacucauuuagaa

SEQ ID NO: 824 - RNA, 19 nt, Artificial Sequence
  source: /note="Description of Artificial Sequence: Synthetic oligonucleotide"
gaagauagagaaaauuggu

SEQ ID NO: 825 - RNA, 19 nt, Artificial Sequence
  source: /note="Description of Artificial Sequence: Synthetic oligonucleotide"
ggucuaaaauugaacaucc

SEQ ID NO: 826 - RNA, 19 nt, Artificial Sequence
  source: /note="Description of Artificial Sequence: Synthetic oligonucleotide"
auccuagauucacacuccc

SEQ ID NO: 827 - RNA, 19 nt, Artificial Sequence
  source: /note="Description of Artificial Sequence: Synthetic oligonucleotide"
ucccaagucacuuaaggug

SEQ ID NO: 828 - RNA, 19 nt, Artificial Sequence
  source: /note="Description of Artificial Sequence: Synthetic oligonucleotide"
gaggaaaaugauugacaaa

SEQ ID NO: 829 - RNA, 19 nt, Artificial Sequence
  source: /note="Description of Artificial Sequence: Synthetic oligonucleotide"
aaagcccaacaaugaucuc

SEQ ID NO: 830 - RNA, 19 nt, Artificial Sequence
  source: /note="Description of Artificial Sequence: Synthetic oligonucleotide"
ucucaggaauuacauuuuc

SEQ ID NO: 831 - RNA, 19 nt, Artificial Sequence
  source: /note="Description of Artificial Sequence: Synthetic oligonucleotide"
auguuuucauguagcagca

SEQ ID NO: 832 - RNA, 19 nt, Artificial Sequence
  source: /note="Description of Artificial Sequence: Synthetic oligonucleotide"
ugcagauuuggugaauauu

SEQ ID NO: 833 - RNA, 19 nt, Artificial Sequence
  source: /note="Description of Artificial Sequence: Synthetic oligonucleotide"
cacuuuaugacugacaauu

SEQ ID NO: 834 - RNA, 19 nt, Artificial Sequence
  source: /note="Description of Artificial Sequence: Synthetic oligonucleotide"
ggccaaauaguaaacaccc

SEQ ID NO: 835 - RNA, 19 nt, Artificial Sequence
  source: /note="Description of Artificial Sequence: Synthetic oligonucleotide"
ccucuguaucucugacagg

SEQ ID NO: 836 - RNA, 19 nt, Artificial Sequence
  source: /note="Description of Artificial Sequence: Synthetic oligonucleotide"
ggaucucucucucuuucug

SEQ ID NO: 837 - RNA, 19 nt, Artificial Sequence
  source: /note="Description of Artificial Sequence: Synthetic oligonucleotide"
cgugucaacguaagacucg

SEQ ID NO: 838 - RNA, 19 nt, Artificial Sequence
  source: /note="Description of Artificial Sequence: Synthetic oligonucleotide"
ugcgucuuucucucugcgu

SEQ ID NO: 839 - RNA, 19 nt, Artificial Sequence
  source: /note="Description of Artificial Sequence: Synthetic oligonucleotide"
uuuguuugucugucucugc

SEQ ID NO: 840 - RNA, 19 nt, Artificial Sequence
  source: /note="Description of Artificial Sequence: Synthetic oligonucleotide"
gagccucuccuaucuguuu

SEQ ID NO: 841 - RNA, 19 nt, Artificial Sequence
  source: /note="Description of Artificial Sequence: Synthetic oligonucleotide"
cauugaaguggcagcguag

SEQ ID NO: 842 - RNA, 19 nt, Artificial Sequence
  source: /note="Description of Artificial Sequence: Synthetic oligonucleotide"
cuucgaaagaacagcagcu

SEQ ID NO: 843 - RNA, 19 nt, Artificial Sequence
  source: /note="Description of Artificial Sequence: Synthetic oligonucleotide"
ccucgcugaaggcuagccc

SEQ ID NO: 844 - RNA, 19 nt, Artificial Sequence
  source: /note="Description of Artificial Sequence: Synthetic oligonucleotide"
gaacacgcucagcacaucc

SEQ ID NO: 845 - RNA, 19 nt, Artificial Sequence
  source: /note="Description of Artificial Sequence: Synthetic oligonucleotide"
cugcuccagcaagugcugg

SEQ ID NO: 846 - RNA, 19 nt, Artificial Sequence
  source: /note="Description of Artificial Sequence: Synthetic oligonucleotide"
aguuaaacacugguugaag

SEQ ID NO: 847 - RNA, 19 nt, Artificial Sequence
  source: /note="Description of Artificial Sequence: Synthetic oligonucleotide"
ccaugaagggaaaagaucu

SEQ ID NO: 848 - RNA, 19 nt, Artificial Sequence
  source: /note="Description of Artificial Sequence: Synthetic oligonucleotide"
gguagcauuugaaaagcca

SEQ ID NO: 849 - RNA, 19 nt, Artificial Sequence
  source: /note="Description of Artificial Sequence: Synthetic oligonucleotide"
uuggagcugguuauuuggg

SEQ ID NO: 850 - RNA, 19 nt, Artificial Sequence
  source: /note="Description of Artificial Sequence: Synthetic oligonucleotide"
cagaugacagagaauuugg

SEQ ID NO: 851 - RNA, 19 nt, Artificial Sequence
  source: /note="Description of Artificial Sequence: Synthetic oligonucleotide"
guucaauugcuguaagacu

SEQ ID NO: 852 - RNA, 19 nt, Artificial Sequence
  source: /note="Description of Artificial Sequence: Synthetic oligonucleotide"
cucacaugggugaaaguuc

SEQ ID NO: 853 - RNA, 19 nt, Artificial Sequence
  source: /note="Description of Artificial Sequence: Synthetic oligonucleotide"
cuuguuuugugcuugggcc

SEQ ID NO: 854 - RNA, 19 nt, Artificial Sequence
  source: /note="Description of Artificial Sequence: Synthetic oligonucleotide"
cuucugaaugacuuggucu

SEQ ID NO: 855 - RNA, 19 nt, Artificial Sequence
  source: /note="Description of Artificial Sequence: Synthetic oligonucleotide"
auaaucgucacugacagga

SEQ ID NO: 856 - RNA, 19 nt, Artificial Sequence
  source: /note="Description of Artificial Sequence: Synthetic oligonucleotide"
gagagaugccagauuaaua

SEQ ID NO: 857 - RNA, 19 nt, Artificial Sequence
  source: /note="Description of Artificial Sequence: Synthetic oligonucleotide"
ggagucaaaaucaauccga

SEQ ID NO: 858 - RNA, 19 nt, Artificial Sequence
  source: /note="Description of Artificial Sequence: Synthetic oligonucleotide"
aagauuucuuuaucagugg

SEQ ID NO: 859 - RNA, 19 nt, Artificial Sequence
  source: /note="Description of Artificial Sequence: Synthetic oligonucleotide"
aaggucaaaaucuuuggga

SEQ ID NO: 860 - RNA, 19 nt, Artificial Sequence
  source: /note="Description of Artificial Sequence: Synthetic oligonucleotide"
aaaaagagucccaauagcc

SEQ ID NO: 861 - RNA, 19 nt, Artificial Sequence
  source: /note="Description of Artificial Sequence: Synthetic oligonucleotide"
gaauaaguuggaaaauugc

SEQ ID NO: 862 - RNA, 19 nt, Artificial Sequence
  source: /note="Description of Artificial Sequence: Synthetic oligonucleotide"
ggaucaaauccaaaugccu

SEQ ID NO: 863 - RNA, 19 nt, Artificial Sequence
  source: /note="Description of Artificial Sequence: Synthetic oligonucleotide"
uaacugucgacuuugggau

SEQ ID NO: 864 - RNA, 19 nt, Artificial Sequence
  source: /note="Description of Artificial Sequence: Synthetic oligonucleotide"
caccaaacacagcaacugc

SEQ ID NO: 865 - RNA, 19 nt, Artificial Sequence
  source: /note="Description of Artificial Sequence: Synthetic oligonucleotide"
aaaaguagguaaaauccac

SEQ ID NO: 866 - RNA, 19 nt, Artificial Sequence
  source: /note="Description of Artificial Sequence: Synthetic oligonucleotide"
uuuaauaacaucuuuagca

SEQ ID NO: 867 - RNA, 19 nt, Artificial Sequence
  source: /note="Description of Artificial Sequence: Synthetic oligonucleotide"
ggguaugaccauucugacc

SEQ ID NO: 868 - RNA, 19 nt, Artificial Sequence
  source: /note="Description of Artificial Sequence: Synthetic oligonucleotide"
guuaucauuuccaaagugg

SEQ ID NO: 869 - RNA, 19 nt, Artificial Sequence
  source: /note="Description of Artificial Sequence: Synthetic oligonucleotide"
uuuuucuugaggaccaaag

SEQ ID NO: 870 - RNA, 19 nt, Artificial Sequence
  source: /note="Description of Artificial Sequence: Synthetic oligonucleotide"
aaugcuuuagguugaugag

SEQ ID NO: 871 - RNA, 19 nt, Artificial Sequence
  source: /note="Description of Artificial Sequence: Synthetic oligonucleotide"
caugucacaccauugaugg

SEQ ID NO: 872 - RNA, 19 nt, Artificial Sequence
  source: /note="Description of Artificial Sequence: Synthetic oligonucleotide"
gcaggauuugcauagcaug

SEQ ID NO: 873 - RNA, 19 nt, Artificial Sequence
  source: /note="Description of Artificial Sequence: Synthetic oligonucleotide"
cauuagcuucugugacagc

SEQ ID NO: 874 - RNA, 19 nt, Artificial Sequence
  source: /note="Description of Artificial Sequence: Synthetic oligonucleotide"
uaucaaaauggauaugucc

SEQ ID NO: 875 - RNA, 19 nt, Artificial Sequence
  source: /note="Description of Artificial Sequence: Synthetic oligonucleotide"
gagauaccacacugacauu

SEQ ID NO: 876 - RNA, 19 nt, Artificial Sequence
  source: /note="Description of Artificial Sequence: Synthetic oligonucleotide"
uuuuuccauccuguagaga

SEQ ID NO: 877 - RNA, 19 nt, Artificial Sequence
  source: /note="Description of Artificial Sequence: Synthetic oligonucleotide"
aaacagguacaugaacuug

SEQ ID NO: 878 - RNA, 19 nt, Artificial Sequence
  source: /note="Description of Artificial Sequence: Synthetic oligonucleotide"
uauuucugacaguuugggc

SEQ ID NO: 879 - RNA, 19 nt, Artificial Sequence
  source: /note="Description of Artificial Sequence: Synthetic oligonucleotide"
cagagcguuaucauccagg

SEQ ID NO: 880 - RNA, 19 nt, Artificial Sequence
  source: /note="Description of Artificial Sequence: Synthetic oligonucleotide"
caucgaugaaauuguggag

SEQ ID NO: 881 - RNA, 19 nt, Artificial Sequence
  source: /note="Description of Artificial Sequence: Synthetic oligonucleotide"
cugaaggagagacaaggug

SEQ ID NO: 882 - RNA, 19 nt, Artificial Sequence
  source: /note="Description of Artificial Sequence: Synthetic oligonucleotide"
gcuauggaaguacugaguc

SEQ ID NO: 883 - RNA, 19 nt, Artificial Sequence
  source: /note="Description of Artificial Sequence: Synthetic oligonucleotide"
ggaaacuccucacauagga

SEQ ID NO: 884 - RNA, 19 nt, Artificial Sequence
  source: /note="Description of Artificial Sequence: Synthetic oligonucleotide"
aaagucuccuaacucgugg

SEQ ID NO: 885 - RNA, 19 nt, Artificial Sequence
  source: /note="Description of Artificial Sequence: Synthetic oligonucleotide"
auugaguaggaucacaaag

SEQ ID NO: 886 - RNA, 19 nt, Artificial Sequence
  source: /note="Description of Artificial Sequence: Synthetic oligonucleotide"
gcuugucgagugcucaucc

SEQ ID NO: 887 - RNA, 19 nt, Artificial Sequence
  source: /note="Description of Artificial Sequence: Synthetic oligonucleotide"
gaaguugaauagcaaggcu

SEQ ID NO: 888 - RNA, 19 nt, Artificial Sequence
  source: /note="Description of Artificial Sequence: Synthetic oligonucleotide"
ggaacaugcagaaaggaag

SEQ ID NO: 889 - RNA, 19 nt, Artificial Sequence
  source: /note="Description of Artificial Sequence: Synthetic oligonucleotide"
uagcccaacauagcaggaa

SEQ ID NO: 890 - RNA, 19 nt, Artificial Sequence
  source: /note="Description of Artificial Sequence: Synthetic oligonucleotide"
caaaaugccaaaagcuagc

SEQ ID NO: 891 - RNA, 19 nt, Artificial Sequence
  source: /note="Description of Artificial Sequence: Synthetic oligonucleotide"
auuuggagcgaaauuguug

SEQ ID NO: 892 - RNA, 19 nt, Artificial Sequence
  source: /note="Description of Artificial Sequence: Synthetic oligonucleotide"
ccagcaagugcaaauauaa

SEQ ID NO: 893 - RNA, 19 nt, Artificial Sequence
  source: /note="Description of Artificial Sequence: Synthetic oligonucleotide"
agaaauauagaggaacaug

SEQ ID NO: 894 - RNA, 19 nt, Artificial Sequence
  source: /note="Description of Artificial Sequence: Synthetic oligonucleotide"
ggaaacauaucugccagag

SEQ ID NO: 895 - RNA, 19 nt, Artificial Sequence
  source: /note="Description of Artificial Sequence: Synthetic oligonucleotide"
cauaucauucaucucugga

SEQ ID NO: 896 - RNA, 19 nt, Artificial Sequence
  source: /note="Description of Artificial Sequence: Synthetic oligonucleotide"
uaccuuuucucucagcaua

SEQ ID NO: 897 - RNA, 19 nt, Artificial Sequence
  source: /note="Description of Artificial Sequence: Synthetic oligonucleotide"
cgguuuuucuuccaguuac

SEQ ID NO: 898 - RNA, 19 nt, Artificial Sequence
  source: /note="Description of Artificial Sequence: Synthetic oligonucleotide"
ugaagaaggugaaaucggu

SEQ ID NO: 899 - RNA, 19 nt, Artificial Sequence
  source: /note="Description of Artificial Sequence: Synthetic oligonucleotide"
caguuaacauuccagcauu

SEQ ID NO: 900 - RNA, 19 nt, Artificial Sequence
  source: /note="Description of Artificial Sequence: Synthetic oligonucleotide"
caagguaaugaguagaaug

SEQ ID NO: 901 - RNA, 19 nt, Artificial Sequence
  source: /note="Description of Artificial Sequence: Synthetic oligonucleotide"
gauuucuccugcauacaag

SEQ ID NO: 902 - RNA, 19 nt, Artificial Sequence
  source: /note="Description of Artificial Sequence: Synthetic oligonucleotide"
cauuuucuauuacuccaau

SEQ ID NO: 903 - RNA, 19 nt, Artificial Sequence
  source: /note="Description of Artificial Sequence: Synthetic oligonucleotide"
ccuuuauuaacaacaccau

SEQ ID NO: 904 - RNA, 19 nt, Artificial Sequence
  source: /note="Description of Artificial Sequence: Synthetic oligonucleotide"
uuuuaucuauuaaaugccu

SEQ ID NO: 905 - RNA, 19 nt, Artificial Sequence
  source: /note="Description of Artificial Sequence: Synthetic oligonucleotide"
aaaauccuuuuuggagaug

SEQ ID NO: 906 - RNA, 19 nt, Artificial Sequence
  source: /note="Description of Artificial Sequence: Synthetic oligonucleotide"
uuuaacuaaauaggaucag

SEQ ID NO: 907 - RNA, 19 nt, Artificial Sequence
  source: /note="Description of Artificial Sequence: Synthetic oligonucleotide"
ggaccuacaguugaaagca

SEQ ID NO: 908 - RNA, 19 nt, Artificial Sequence
  source: /note="Description of Artificial Sequence: Synthetic oligonucleotide"
aauaauuaguuuucuggac

SEQ ID NO: 909 - RNA, 19 nt, Artificial Sequence
  source: /note="Description of Artificial Sequence: Synthetic oligonucleotide"
ggacuauuucacagacuga

SEQ ID NO: 910 - RNA, 19 nt, Artificial Sequence
  source: /note="Description of Artificial Sequence: Synthetic oligonucleotide"
uuaacaacaaauaauggac

SEQ ID NO: 911 - RNA, 19 nt, Artificial Sequence
  source: /note="Description of Artificial Sequence: Synthetic oligonucleotide"
ccuuuugaagcauuuuuaa

SEQ ID NO: 912 - RNA, 19 nt, Artificial Sequence
  source: /note="Description of Artificial Sequence: Synthetic oligonucleotide"
cagacugacacugaaaacc

SEQ ID NO: 913 - RNA, 19 nt, Artificial Sequence
  source: /note="Description of Artificial Sequence: Synthetic oligonucleotide"
caaaggcuccuauauacca

SEQ ID NO: 914 - RNA, 19 nt, Artificial Sequence
  source: /note="Description of Artificial Sequence: Synthetic oligonucleotide"
ugaaaaauagguauuuccc

SEQ ID NO: 915 - RNA, 19 nt, Artificial Sequence
  source: /note="Description of Artificial Sequence: Synthetic oligonucleotide"
aauaugcauggaauacuga

SEQ ID NO: 916 - RNA, 19 nt, Artificial Sequence
  source: /note="Description of Artificial Sequence: Synthetic oligonucleotide"
ugucucuugcuucauggug

SEQ ID NO: 917 - RNA, 19 nt, Artificial Sequence
  source: /note="Description of Artificial Sequence: Synthetic oligonucleotide"
ugauuauagaaugcauguc

SEQ ID NO: 918 - RNA, 19 nt, Artificial Sequence
  source: /note="Description of Artificial Sequence: Synthetic oligonucleotide"
cugagucugagugucuaca

SEQ ID NO: 919 - RNA, 19 nt, Artificial Sequence
  source: /note="Description of Artificial Sequence: Synthetic oligonucleotide"
auauaacuuguauuuuccc

SEQ ID NO: 920 - RNA, 19 nt, Artificial Sequence
  source: /note="Description of Artificial Sequence: Synthetic oligonucleotide"
gaguuuuaaaggcuuucag

SEQ ID NO: 921 - RNA, 19 nt, Artificial Sequence
  source: /note="Description of Artificial Sequence: Synthetic oligonucleotide"
ugaaucuuugauccuacca

SEQ ID NO: 922 - RNA, 19 nt, Artificial Sequence
  source: /note="Description of Artificial Sequence: Synthetic oligonucleotide"
cucucugaaaccauuugaa

SEQ ID NO: 923 - RNA, 19 nt, Artificial Sequence
  source: /note="Description of Artificial Sequence: Synthetic oligonucleotide"
uuaauugaaauaaaaccuc

SEQ ID NO: 924 - RNA, 19 nt, Artificial Sequence
  source: /note="Description of Artificial Sequence: Synthetic oligonucleotide"
ucuugaaagcacuagaaca

SEQ ID NO: 925 - RNA, 19 nt, Artificial Sequence
  source: /note="Description of Artificial Sequence: Synthetic oligonucleotide"
cauuuugauguacuugcuc

SEQ ID NO: 926 - RNA, 19 nt, Artificial Sequence
  source: /note="Description of Artificial Sequence: Synthetic oligonucleotide"
cauacauuuuaccuucuac

SEQ ID NO: 927 - RNA, 19 nt, Artificial Sequence
  source: /note="Description of Artificial Sequence: Synthetic oligonucleotide"
uaauuuauauuaguguugc

SEQ ID NO: 928 - RNA, 19 nt, Artificial Sequence
  source: /note="Description of Artificial Sequence: Synthetic oligonucleotide"
cuccuuaaagacuuggaau

SEQ ID NO: 929 - RNA, 19 nt, Artificial Sequence
  source: /note="Description of Artificial Sequence: Synthetic oligonucleotide"
gaacaaaaagcugugagaa

SEQ ID NO: 930 - RNA, 19 nt, Artificial Sequence
  source: /note="Description of Artificial Sequence: Synthetic oligonucleotide"
aauugaaauacaaaacaga

SEQ ID NO: 931 - RNA, 19 nt, Artificial Sequence
  source: /note="Description of Artificial Sequence: Synthetic oligonucleotide"
aaaauaauacugcaaguuc

SEQ ID NO: 932 - RNA, 19 nt, Artificial Sequence
  source: /note="Description of Artificial Sequence: Synthetic oligonucleotide"
ccuauuauuuuagaauggu

SEQ ID NO: 933 - RNA, 19 nt, Artificial Sequence
  source: /note="Description of Artificial Sequence: Synthetic oligonucleotide"
uuauuuauuuccuaacucc

SEQ ID NO: 934 - RNA, 19 nt, Artificial Sequence
  source: /note="Description of Artificial Sequence: Synthetic oligonucleotide"
cagggcuagcaaaacuuua

SEQ ID NO: 935 - RNA, 19 nt, Artificial Sequence
  source: /note="Description of Artificial Sequence: Synthetic oligonucleotide"
cuaagccugaacuuagcag

SEQ ID NO: 936 - RNA, 19 nt, Artificial Sequence
  source: /note="Description of Artificial Sequence: Synthetic oligonucleotide"
gugaaguuuauacuuagcg

SEQ ID NO: 937 - RNA, 19 nt, Artificial Sequence
  source: /note="Description of Artificial Sequence: Synthetic oligonucleotide"
cuuuucguggaaucuggug

SEQ ID NO: 938 - RNA, 19 nt, Artificial Sequence
  source: /note="Description of Artificial Sequence: Synthetic oligonucleotide"
caaccacaacauaagucag

SEQ ID NO: 939 - RNA, 19 nt, Artificial Sequence
  source: /note="Description of Artificial Sequence: Synthetic oligonucleotide"
cuguucugccauuugugag

SEQ ID NO: 940 - RNA, 19 nt, Artificial Sequence
  source: /note="Description of Artificial Sequence: Synthetic oligonucleotide"
uguuaccagcuuuacauac

SEQ ID NO: 941 - RNA, 19 nt, Artificial Sequence
  source: /note="Description of Artificial Sequence: Synthetic oligonucleotide"
gcacugaaaccgagguguu

SEQ ID NO: 942 - RNA, 19 nt, Artificial Sequence
  source: /note="Description of Artificial Sequence: Synthetic oligonucleotide"
caaagcaaacacauggugc

SEQ ID NO: 943 - RNA, 19 nt, Artificial Sequence
  source: /note="Description of Artificial Sequence: Synthetic oligonucleotide"
caacauauucuucaccuuc

SEQ ID NO: 944 - RNA, 19 nt, Artificial Sequence
  source: /note="Description of Artificial Sequence: Synthetic oligonucleotide"
caauuucuuucucuaaacc

SEQ ID NO: 945 - RNA, 19 nt, Artificial Sequence
  source: /note="Description of Artificial Sequence: Synthetic oligonucleotide"
gcauaaaauuacauccaau

SEQ ID NO: 946 - RNA, 19 nt, Artificial Sequence
  source: /note="Description of Artificial Sequence: Synthetic oligonucleotide"
ucuuuaaaaguaaauugca

SEQ ID NO: 947 - RNA, 19 nt, Artificial Sequence
  source: /note="Description of Artificial Sequence: Synthetic oligonucleotide"
cuaaauaguuauguuuguc

SEQ ID NO: 948 - RNA, 19 nt, Artificial Sequence
  source: /note="Description of Artificial Sequence: Synthetic oligonucleotide"
uuauuaaaauauucucugc

SEQ ID NO: 949 - RNA, 19 nt, Artificial Sequence
  source: /note="Description of Artificial Sequence: Synthetic oligonucleotide"
guccagcuguuguuuugca

SEQ ID NO: 950 - RNA, 19 nt, Artificial Sequence
  source: /note="Description of Artificial Sequence: Synthetic oligonucleotide"
guccuugauguacagcagu

SEQ ID NO: 951 - RNA, 19 nt, Artificial Sequence
  source: /note="Description of Artificial Sequence: Synthetic oligonucleotide"
guuuuccaguuaaucuguc

SEQ ID NO: 952 - RNA, 19 nt, Artificial Sequence
  source: /note="Description of Artificial Sequence: Synthetic oligonucleotide"
ucgaucacacauaaggaac

SEQ ID NO: 953 - RNA, 19 nt, Artificial Sequence
  source: /note="Description of Artificial Sequence: Synthetic oligonucleotide"
caaaggaagucuuuucuga

SEQ ID NO: 954 - RNA, 19 nt, Artificial Sequence
  source: /note="Description of Artificial Sequence: Synthetic oligonucleotide"
cauauggaaaaguauaggc

SEQ ID NO: 955 - RNA, 19 nt, Artificial Sequence
  source: /note="Description of Artificial Sequence: Synthetic oligonucleotide"
uuuuucaagguauaccaua

SEQ ID NO: 956 - RNA, 19 nt, Artificial Sequence
  source: /note="Description of Artificial Sequence: Synthetic oligonucleotide"
agaaaaauaaccauggugu

SEQ ID NO: 957 - RNA, 19 nt, Artificial Sequence
  source: /note="Description of Artificial Sequence: Synthetic oligonucleotide"
ugucuuuuauaaaagguag

SEQ ID NO: 958 - RNA, 19 nt, Artificial Sequence
  source: /note="Description of Artificial Sequence: Synthetic oligonucleotide"
uucuaaaugaguaaacagg

SEQ ID NO: 959 - RNA, 19 nt, Artificial Sequence
  source: /note="Description of Artificial Sequence: Synthetic oligonucleotide"
accaauuuucucuaucuuc

SEQ ID NO: 960 - RNA, 19 nt, Artificial Sequence
  source: /note="Description of Artificial Sequence: Synthetic oligonucleotide"
ggauguucaauuuuagacc

SEQ ID NO: 961 - RNA, 19 nt, Artificial Sequence
  source: /note="Description of Artificial Sequence: Synthetic oligonucleotide"
gggagugugaaucuaggau

SEQ ID NO: 962 - RNA, 19 nt, Artificial Sequence
  source: /note="Description of Artificial Sequence: Synthetic oligonucleotide"
caccuuaagugacuuggga

SEQ ID NO: 963 - RNA, 19 nt, Artificial Sequence
  source: /note="Description of Artificial Sequence: Synthetic oligonucleotide"
uuugucaaucauuuuccuc

SEQ ID NO: 964 - RNA, 19 nt, Artificial Sequence
  source: /note="Description of Artificial Sequence: Synthetic oligonucleotide"
gagaucauuguugggcuuu

SEQ ID NO: 965 - RNA, 19 nt, Artificial Sequence
  source: /note="Description of Artificial Sequence: Synthetic oligonucleotide"
gaaaauguaauuccugaga

SEQ ID NO: 966 - RNA, 19 nt, Artificial Sequence
  source: /note="Description of Artificial Sequence: Synthetic oligonucleotide"
ugcugcuacaugaaaacau

SEQ ID NO: 967 - RNA, 19 nt, Artificial Sequence
  source: /note="Description of Artificial Sequence: Synthetic oligonucleotide"
aauauucaccaaaucugca

SEQ ID NO: 968 - RNA, 19 nt, Artificial Sequence
  source: /note="Description of Artificial Sequence: Synthetic oligonucleotide"
aauugucagucauaaagug

SEQ ID NO: 969 - RNA, 19 nt, Artificial Sequence
  source: /note="Description of Artificial Sequence: Synthetic oligonucleotide"
ggguguuuacuauuuggcc

SEQ ID NO: 970 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccugucagagauacagaggtt

SEQ ID NO: 971 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagaaagagagagagaucctt

SEQ ID NO: 972 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgagucuuacguugacacgtt

SEQ ID NO: 973 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgcagagagaaagacgcatt

SEQ ID NO: 974 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcagagacagacaaacaaatt

SEQ ID NO: 975 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaacagauaggagaggcuctt

SEQ ID NO: 976 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuacgcugccacuucaaugtt

SEQ ID NO: 977 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcugcuguucuuucgaagtt

SEQ ID NO: 978 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggcuagccuucagcgaggtt

SEQ ID NO: 979 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaugugcugagcguguuctt

SEQ ID NO: 980 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccagcacuugcuggagcagtt

SEQ ID NO: 981 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucaaccaguguuuaacutt

SEQ ID NO: 982 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaucuuuucccuucauggtt

SEQ ID NO: 983 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggcuuuucaaaugcuacctt

SEQ ID NO: 984 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccaaauaaccagcuccaatt

SEQ ID NO: 985 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaaauucucugucaucugtt

SEQ ID NO: 986 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agucuuacagcaauugaactt

SEQ ID NO: 987 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaacuuucacccaugugagtt

SEQ ID NO: 988 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcccaagcacaaaacaagtt

SEQ ID NO: 989 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaccaagucauucagaagtt

SEQ ID NO: 990 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccugucagugacgauuautt

SEQ ID NO: 991 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauuaaucuggcaucucuctt

SEQ ID NO: 992 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucggauugauuuugacucctt

SEQ ID NO: 993 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccacugauaaagaaaucuutt

SEQ ID NO: 994 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccaaagauuuugaccuutt

SEQ ID NO: 995 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcuauugggacucuuuuutt

SEQ ID NO: 996 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcaauuuuccaacuuauuctt

SEQ ID NO: 997 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcauuuggauuugaucctt

SEQ ID NO: 998 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucccaaagucgacaguuatt

SEQ ID NO: 999 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcaguugcuguguuuggugtt

SEQ ID NO: 1000 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guggauuuuaccuacuuuutt

SEQ ID NO: 1001 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuaaagauguuauuaaatt

SEQ ID NO: 1002 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggucagaauggucauaccctt

SEQ ID NO: 1003 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccacuuuggaaaugauaactt

SEQ ID NO: 1004 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuugguccucaagaaaaatt

SEQ ID NO: 1005 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucaucaaccuaaagcauutt

SEQ ID NO: 1006 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaucaauggugugacaugtt

SEQ ID NO: 1007 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caugcuaugcaaauccugctt

SEQ ID NO: 1008 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcugucacagaagcuaaugtt

SEQ ID NO: 1009 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggacauauccauuuugauatt

SEQ ID NO: 1010 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaugucagugugguaucuctt

SEQ ID NO: 1011 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucuacaggauggaaaaatt

SEQ ID NO: 1012 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaguucauguaccuguuutt

SEQ ID NO: 1013 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcccaaacugucagaaauatt

SEQ ID NO: 1014 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuggaugauaacgcucugtt

SEQ ID NO: 1015 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuccacaauuucaucgaugtt

SEQ ID NO: 1016 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caccuugucucuccuucagtt

SEQ ID NO: 1017 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacucaguacuuccauagctt

SEQ ID NO: 1018 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccuaugugaggaguuucctt

SEQ ID NO: 1019 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccacgaguuaggagacuuutt

SEQ ID NO: 1020 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuugugauccuacucaautt

SEQ ID NO: 1021 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaugagcacucgacaagctt

SEQ ID NO: 1022 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agccuugcuauucaacuuctt

SEQ ID NO: 1023 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuccuuucugcauguucctt

SEQ ID NO: 1024 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccugcuauguugggcuatt

SEQ ID NO: 1025 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuagcuuuuggcauuuugtt

SEQ ID NO: 1026 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caacaauuucgcuccaaautt

SEQ ID NO: 1027 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuauauuugcacuugcuggtt

SEQ ID NO: 1028 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauguuccucuauauuucutt

SEQ ID NO: 1029 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucuggcagauauguuucctt

SEQ ID NO: 1030 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccagagaugaaugauaugtt

SEQ ID NO: 1031 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaugcugagagaaaagguatt

SEQ ID NO: 1032 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guaacuggaagaaaaaccgtt

SEQ ID NO: 1033 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accgauuucaccuucuucatt

SEQ ID NO: 1034 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaugcuggaauguuaacugtt

SEQ ID NO: 1035 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauucuacucauuaccuugtt

SEQ ID NO: 1036 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuguaugcaggagaaauctt

SEQ ID NO: 1037 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuggaguaauagaaaaugtt

SEQ ID NO: 1038 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augguguuguuaauaaaggtt

SEQ ID NO: 1039 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcauuuaauagauaaaatt

SEQ ID NO: 1040 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucuccaaaaaggauuuutt

SEQ ID NO: 1041 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugauccuauuuaguuaaatt

SEQ ID NO: 1042 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuuucaacuguaggucctt

SEQ ID NO: 1043 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guccagaaaacuaauuauutt

SEQ ID NO: 1044 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagucugugaaauagucctt

SEQ ID NO: 1045 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guccauuauuuguuguuaatt

SEQ ID NO: 1046 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaaaaaugcuucaaaaggtt

SEQ ID NO: 1047 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gguuuucagugucagucugtt

SEQ ID NO: 1048 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugguauauaggagccuuugtt

SEQ ID NO: 1049 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggaaauaccuauuuuucatt

SEQ ID NO: 1050 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaguauuccaugcauauutt

SEQ ID NO: 1051 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caccaugaagcaagagacatt

SEQ ID NO: 1052 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacaugcauucuauaaucatt

SEQ ID NO: 1053 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguagacacucagacucagtt

SEQ ID NO: 1054 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggaaaauacaaguuauautt

SEQ ID NO: 1055 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugaaagccuuuaaaacuctt

SEQ ID NO: 1056 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugguaggaucaaagauucatt

SEQ ID NO: 1057 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucaaaugguuucagagagtt

SEQ ID NO: 1058 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagguuuuauuucaauuaatt

SEQ ID NO: 1059 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguucuagugcuuucaagatt

SEQ ID NO: 1060 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagcaaguacaucaaaaugtt

SEQ ID NO: 1061 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guagaagguaaaauguaugtt

SEQ ID NO: 1062 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcaacacuaauauaaauuatt

SEQ ID NO: 1063 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuccaagucuuuaaggagtt

SEQ ID NO: 1064 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucucacagcuuuuuguuctt

SEQ ID NO: 1065 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuguuuuguauuucaauutt

SEQ ID NO: 1066 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaacuugcaguauuauuuutt

SEQ ID NO: 1067 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accauucuaaaauaauaggtt

SEQ ID NO: 1068 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaguuaggaaauaaauaatt

SEQ ID NO: 1069 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaaguuuugcuagcccugtt

SEQ ID NO: 1070 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuaaguucaggcuuagtt

SEQ ID NO: 1071 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcuaaguauaaacuucactt

SEQ ID NO: 1072 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caccagauuccacgaaaagtt

SEQ ID NO: 1073 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugacuuauguugugguugtt

SEQ ID NO: 1074 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucacaaauggcagaacagtt

SEQ ID NO: 1075 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guauguaaagcugguaacatt

SEQ ID NO: 1076 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacaccucgguuucagugctt

SEQ ID NO: 1077 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcaccauguguuugcuuugtt

SEQ ID NO: 1078 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaggugaagaauauguugtt

SEQ ID NO: 1079 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gguuuagagaaagaaauugtt

SEQ ID NO: 1080 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuggauguaauuuuaugctt

SEQ ID NO: 1081 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcaauuuacuuuuaaagatt

SEQ ID NO: 1082 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacaaacauaacuauuuagtt

SEQ ID NO: 1083 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcagagaauauuuuaauaatt

SEQ ID NO: 1084 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcaaaacaacagcuggactt

SEQ ID NO: 1085 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acugcuguacaucaaggactt

SEQ ID NO: 1086 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacagauuaacuggaaaactt

SEQ ID NO: 1087 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuccuuaugugugaucgatt

SEQ ID NO: 1088 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagaaaagacuuccuuugtt

SEQ ID NO: 1089 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccuauacuuuuccauaugtt

SEQ ID NO: 1090 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaugguauaccuugaaaaatt

SEQ ID NO: 1091 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaccaugguuauuuuucutt

SEQ ID NO: 1092 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuaccuuuuauaaaagacatt

SEQ ID NO: 1093 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuguuuacucauuuagaatt

SEQ ID NO: 1094 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaagauagagaaaauuggutt

SEQ ID NO: 1095 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggucuaaaauugaacaucctt

SEQ ID NO: 1096 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auccuagauucacacuccctt

SEQ ID NO: 1097 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccaagucacuuaaggugtt

SEQ ID NO: 1098 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaggaaaaugauugacaaatt

SEQ ID NO: 1099 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagcccaacaaugaucuctt

SEQ ID NO: 1100 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucaggaauuacauuuuctt

SEQ ID NO: 1101 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auguuuucauguagcagcatt

SEQ ID NO: 1102 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcagauuuggugaauauutt

SEQ ID NO: 1103 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacuuuaugacugacaauutt

SEQ ID NO: 1104 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggccaaauaguaaacaccctt

SEQ ID NO: 1105 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccucuguaucucugacaggtt

SEQ ID NO: 1106 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaucucucucucuuucugtt

SEQ ID NO: 1107 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgugucaacguaagacucgtt

SEQ ID NO: 1108 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcgucuuucucucugcgutt

SEQ ID NO: 1109 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuguuugucugucucugctt

SEQ ID NO: 1110 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagccucuccuaucuguuutt

SEQ ID NO: 1111 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauugaaguggcagcguagtt

SEQ ID NO: 1112 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucgaaagaacagcagcutt

SEQ ID NO: 1113 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccucgcugaaggcuagccctt

SEQ ID NO: 1114 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaacacgcucagcacaucctt

SEQ ID NO: 1115 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuccagcaagugcuggtt

SEQ ID NO: 1116 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguuaaacacugguugaagtt

SEQ ID NO: 1117 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaugaagggaaaagaucutt

SEQ ID NO: 1118 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gguagcauuugaaaagccatt

SEQ ID NO: 1119 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggagcugguuauuugggtt

SEQ ID NO: 1120 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagaugacagagaauuuggtt

SEQ ID NO: 1121 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guucaauugcuguaagacutt

SEQ ID NO: 1122 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucacaugggugaaaguuctt

SEQ ID NO: 1123 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuguuuugugcuugggcctt

SEQ ID NO: 1124 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucugaaugacuuggucutt

SEQ ID NO: 1125 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auaaucgucacugacaggatt

SEQ ID NO: 1126 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagagaugccagauuaauatt

SEQ ID NO: 1127 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggagucaaaaucaauccgatt

SEQ ID NO: 1128 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagauuucuuuaucaguggtt

SEQ ID NO: 1129 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaggucaaaaucuuugggatt

SEQ ID NO: 1130 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaaagagucccaauagcctt

SEQ ID NO: 1131 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaauaaguuggaaaauugctt

SEQ ID NO: 1132 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaucaaauccaaaugccutt

SEQ ID NO: 1133 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaacugucgacuuugggautt

SEQ ID NO: 1134 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caccaaacacagcaacugctt

SEQ ID NO: 1135 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaaguagguaaaauccactt

SEQ ID NO: 1136 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuaauaacaucuuuagcatt

SEQ ID NO: 1137 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggguaugaccauucugacctt

SEQ ID NO: 1138 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuaucauuuccaaaguggtt

SEQ ID NO: 1139 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuucuugaggaccaaagtt

SEQ ID NO: 1140 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaugcuuuagguugaugagtt

SEQ ID NO: 1141 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caugucacaccauugauggtt

SEQ ID NO: 1142 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcaggauuugcauagcaugtt

SEQ ID NO: 1143 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauuagcuucugugacagctt

SEQ ID NO: 1144 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaucaaaauggauaugucctt

SEQ ID NO: 1145 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagauaccacacugacauutt

SEQ ID NO: 1146 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuuccauccuguagagatt

SEQ ID NO: 1147 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaacagguacaugaacuugtt

SEQ ID NO: 1148 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauuucugacaguuugggctt

SEQ ID NO: 1149 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagagcguuaucauccaggtt

SEQ ID NO: 1150 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucgaugaaauuguggagtt

SEQ ID NO: 1151 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugaaggagagacaaggugtt

SEQ ID NO: 1152 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuauggaaguacugaguctt

SEQ ID NO: 1153 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaaacuccucacauaggatt

SEQ ID NO: 1154 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagucuccuaacucguggtt

SEQ ID NO: 1155 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auugaguaggaucacaaagtt

SEQ ID NO: 1156 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuugucgagugcucaucctt

SEQ ID NO: 1157 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaguugaauagcaaggcutt

SEQ ID NO: 1158 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaacaugcagaaaggaagtt

SEQ ID NO: 1159 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagcccaacauagcaggaatt

SEQ ID NO: 1160 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaaaugccaaaagcuagctt

SEQ ID NO: 1161 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuuggagcgaaauuguugtt

SEQ ID NO: 1162 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccagcaagugcaaauauaatt

SEQ ID NO: 1163 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaaauauagaggaacaugtt

SEQ ID NO: 1164 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaaacauaucugccagagtt

SEQ ID NO: 1165 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauaucauucaucucuggatt

SEQ ID NO: 1166 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaccuuuucucucagcauatt

SEQ ID NO: 1167 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgguuuuucuuccaguuactt

SEQ ID NO: 1168 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaagaaggugaaaucggutt

SEQ ID NO: 1169 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caguuaacauuccagcauutt

SEQ ID NO: 1170 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caagguaaugaguagaaugtt

SEQ ID NO: 1171 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauuucuccugcauacaagtt

SEQ ID NO: 1172 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauuuucuauuacuccaautt

SEQ ID NO: 1173 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuuuauuaacaacaccautt

SEQ ID NO: 1174 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuaucuauuaaaugccutt

SEQ ID NO: 1175 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaauccuuuuuggagaugtt

SEQ ID NO: 1176 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuaacuaaauaggaucagtt

SEQ ID NO: 1177 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaccuacaguugaaagcatt

SEQ ID NO: 1178 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauaauuaguuuucuggactt

SEQ ID NO: 1179 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggacuauuucacagacugatt

SEQ ID NO: 1180 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaacaacaaauaauggactt

SEQ ID NO: 1181 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuuuugaagcauuuuuaatt

SEQ ID NO: 1182 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagacugacacugaaaacctt

SEQ ID NO: 1183 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaaggcuccuauauaccatt

SEQ ID NO: 1184 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaaaaauagguauuuccctt

SEQ ID NO: 1185 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauaugcauggaauacugatt

SEQ ID NO: 1186 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucucuugcuucauggugtt

SEQ ID NO: 1187 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugauuauagaaugcauguctt

SEQ ID NO: 1188 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugagucugagugucuacatt

SEQ ID NO: 1189 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auauaacuuguauuuuccctt

SEQ ID NO: 1190 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaguuuuaaaggcuuucagtt

SEQ ID NO: 1191 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaaucuuugauccuaccatt

SEQ ID NO: 1192 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucucugaaaccauuugaatt

SEQ ID NO: 1193 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaauugaaauaaaaccuctt

SEQ ID NO: 1194 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuugaaagcacuagaacatt

SEQ ID NO: 1195 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauuuugauguacuugcuctt

SEQ ID NO: 1196 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauacauuuuaccuucuactt

SEQ ID NO: 1197 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaauuuauauuaguguugctt

SEQ ID NO: 1198 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuccuuaaagacuuggaautt

SEQ ID NO: 1199 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaacaaaaagcugugagaatt

SEQ ID NO: 1200 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauugaaauacaaaacagatt

SEQ ID NO: 1201 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaauaauacugcaaguuctt

SEQ ID NO: 1202 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuauuauuuuagaauggutt

SEQ ID NO: 1203 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuauuuauuuccuaacucctt

SEQ ID NO: 1204 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagggcuagcaaaacuuuatt

SEQ ID NO: 1205 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuaagccugaacuuagcagtt

SEQ ID NO: 1206 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugaaguuuauacuuagcgtt

SEQ ID NO: 1207 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuucguggaaucuggugtt

SEQ ID NO: 1208 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaccacaacauaagucagtt

SEQ ID NO: 1209 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuguucugccauuugugagtt

SEQ ID NO: 1210 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguuaccagcuuuacauactt

SEQ ID NO: 1211 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcacugaaaccgagguguutt

SEQ ID NO: 1212 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaagcaaacacauggugctt

SEQ ID NO: 1213 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caacauauucuucaccuuctt

SEQ ID NO: 1214 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caauuucuuucucuaaacctt

SEQ ID NO: 1215 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcauaaaauuacauccaautt

SEQ ID NO: 1216 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuuuaaaaguaaauugcatt

SEQ ID NO: 1217 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuaaauaguuauguuuguctt

SEQ ID NO: 1218 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuauuaaaauauucucugctt

SEQ ID NO: 1219 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guccagcuguuguuuugcatt

SEQ ID NO: 1220 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guccuugauguacagcagutt

SEQ ID NO: 1221 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuuuccaguuaaucuguctt

SEQ ID NO: 1222 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgaucacacauaaggaactt

SEQ ID NO: 1223 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaaggaagucuuuucugatt

SEQ ID NO: 1224 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauauggaaaaguauaggctt

SEQ ID NO: 1225 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuucaagguauaccauatt

SEQ ID NO: 1226 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaaaaauaaccauggugutt

SEQ ID NO: 1227 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucuuuuauaaaagguagtt

SEQ ID NO: 1228 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuaaaugaguaaacaggtt

SEQ ID NO: 1229 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accaauuuucucuaucuuctt

SEQ ID NO: 1230 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggauguucaauuuuagacctt

SEQ ID NO: 1231 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggagugugaaucuaggautt

SEQ ID NO: 1232 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caccuuaagugacuugggatt

SEQ ID NO: 1233 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuugucaaucauuuuccuctt

SEQ ID NO: 1234 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagaucauuguugggcuuutt

SEQ ID NO: 1235 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaaauguaauuccugagatt

SEQ ID NO: 1236 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcugcuacaugaaaacautt

SEQ ID NO: 1237 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauauucaccaaaucugcatt

SEQ ID NO: 1238 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauugucagucauaaagugtt

SEQ ID NO: 1239 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggguguuuacuauuuggcctt

SEQ ID NO: 1240 - DNA, 19 bp, Artificial Sequence
  source: /note="Description of Artificial Sequence: Synthetic oligonucleotide"
cctgtcagagatacagagg

SEQ ID NO: 1241 - DNA, 19 bp, Artificial Sequence
  source: /note="Description of Artificial Sequence: Synthetic oligonucleotide"
cagaaagagagagagatcc

SEQ ID NO: 1242 - DNA, 19 bp, Artificial Sequence
  source: /note="Description of Artificial Sequence: Synthetic oligonucleotide"
cgagtcttacgttgacacg

SEQ ID NO: 1243 - DNA, 19 bp, Artificial Sequence
  source: /note="Description of Artificial Sequence: Synthetic oligonucleotide"
acgcagagagaaagacgca

SEQ ID NO: 1244 - DNA, 19 bp, Artificial Sequence
  source: /note="Description of Artificial Sequence: Synthetic oligonucleotide"
gcagagacagacaaacaaa

SEQ ID NO: 1245 - DNA, 19 bp, Artificial Sequence
  source: /note="Description of Artificial Sequence: Synthetic oligonucleotide"
aaacagataggagaggctc

SEQ ID NO: 1246 - DNA, 19 bp, Artificial Sequence
  source: /note="Description of Artificial Sequence: Synthetic oligonucleotide"
ctacgctgccacttcaatg

SEQ ID NO: 1247 - DNA, 19 bp, Artificial Sequence
  source: /note="Description of Artificial Sequence: Synthetic oligonucleotide"
agctgctgttctttcgaag

SEQ ID NO: 1248 - DNA, 19 bp, Artificial Sequence
  source: /note="Description of Artificial Sequence: Synthetic oligonucleotide"
gggctagccttcagcgagg

SEQ ID NO: 1249 - DNA, 19 bp, Artificial Sequence
  source: /note="Description of Artificial Sequence: Synthetic oligonucleotide"
ggatgtgctgagcgtgttc

SEQ ID NO: 1250 - DNA, 19 bp, Artificial Sequence
  source: /note="Description of Artificial Sequence: Synthetic oligonucleotide"
ccagcacttgctggagcag

SEQ ID NO: 1251 - DNA, 19 bp, Artificial Sequence
  source: /note="Description of Artificial Sequence: Synthetic oligonucleotide"
cttcaaccagtgtttaact

SEQ ID NO: 1252 - DNA, 19 bp, Artificial Sequence
  source: /note="Description of Artificial Sequence: Synthetic oligonucleotide"
agatcttttcccttcatgg

SEQ ID NO: 1253 - DNA, 19 bp, Artificial Sequence
  source: /note="Description of Artificial Sequence: Synthetic oligonucleotide"
tggcttttcaaatgctacc

SEQ ID NO: 1254 - DNA, 19 bp, Artificial Sequence
  source: /note="Description of Artificial Sequence: Synthetic oligonucleotide"
cccaaataaccagctccaa

SEQ ID NO: 1255 - DNA, 19 bp, Artificial Sequence
  source: /note="Description of Artificial Sequence: Synthetic oligonucleotide"
ccaaattctctgtcatctg

SEQ ID NO: 1256 - DNA, 19 bp, Artificial Sequence
  source: /note="Description of Artificial Sequence: Synthetic oligonucleotide"
agtcttacagcaattgaac

SEQ ID NO: 1257 - DNA, 19 bp, Artificial Sequence
  source: /note="Description of Artificial Sequence: Synthetic oligonucleotide"
gaactttcacccatgtgag

SEQ ID NO: 1258 - DNA, 19 bp, Artificial Sequence
  source: /note="Description of Artificial Sequence: Synthetic oligonucleotide"
ggcccaagcacaaaacaag

SEQ ID NO: 1259 - DNA, 19 bp, Artificial Sequence
  source: /note="Description of Artificial Sequence: Synthetic oligonucleotide"
agaccaagtcattcagaag

SEQ ID NO: 1260 - DNA, 19 bp, Artificial Sequence
  source: /note="Description of Artificial Sequence: Synthetic oligonucleotide"
tcctgtcagtgacgattat

SEQ ID NO: 1261 - DNA, 19 bp, Artificial Sequence
  source: /note="Description of Artificial Sequence: Synthetic oligonucleotide"
tattaatctggcatctctc

SEQ ID NO: 1262 - DNA, 19 bp, Artificial Sequence
  source: /note="Description of Artificial Sequence: Synthetic oligonucleotide"
tcggattgattttgactcc

SEQ ID NO: 1263 - DNA, 19 bp, Artificial Sequence
  source: /note="Description of Artificial Sequence: Synthetic oligonucleotide"
ccactgataaagaaatctt

SEQ ID NO: 1264 - DNA, 19 bp, Artificial Sequence
  source: /note="Description of Artificial Sequence: Synthetic oligonucleotide"
tcccaaagattttgacctt

SEQ ID NO: 1265 - DNA, 19 bp, Artificial Sequence
  source: /note="Description of Artificial Sequence: Synthetic oligonucleotide"
ggctattgggactcttttt

SEQ ID NO: 1266 - DNA, 19 bp, Artificial Sequence
  source: /note="Description of Artificial Sequence: Synthetic oligonucleotide"
gcaattttccaacttattc

SEQ ID NO: 1267 - DNA, 19 bp, Artificial Sequence
  source: /note="Description of Artificial Sequence: Synthetic oligonucleotide"
aggcatttggatttgatcc

SEQ ID NO: 1268 - DNA, 19 bp, Artificial Sequence
  source: /note="Description of Artificial Sequence: Synthetic oligonucleotide"
atcccaaagtcgacagtta

SEQ ID NO: 1269 - DNA, 19 bp, Artificial Sequence
  source: /note="Description of Artificial Sequence: Synthetic oligonucleotide"
gcagttgctgtgtttggtg

SEQ ID NO: 1270 - DNA, 19 bp, Artificial Sequence
  source: /note="Description of Artificial Sequence: Synthetic oligonucleotide"
gtggattttacctactttt

SEQ ID NO: 1271 - DNA, 19 bp, Artificial Sequence
  source: /note="Description of Artificial Sequence: Synthetic oligonucleotide"
tgctaaagatgttattaaa

SEQ ID NO: 1272 - DNA, 19 bp, Artificial Sequence
  source: /note="Description of Artificial Sequence: Synthetic oligonucleotide"
ggtcagaatggtcataccc

SEQ ID NO: 1273 - DNA, 19 bp, Artificial Sequence
  source: /note="Description of Artificial Sequence: Synthetic oligonucleotide"
ccactttggaaatgataac

SEQ ID NO: 1274 - DNA, 19 bp, Artificial Sequence
  source: /note="Description of Artificial Sequence: Synthetic oligonucleotide"
ctttggtcctcaagaaaaa

SEQ ID NO: 1275 - DNA, 19 bp, Artificial Sequence
  source: /note="Description of Artificial Sequence: Synthetic oligonucleotide"
ctcatcaacctaaagcatt

SEQ ID NO: 1276 - DNA, 19 bp, Artificial Sequence
  source: /note="Description of Artificial Sequence: Synthetic oligonucleotide"
ccatcaatggtgtgacatg

SEQ ID NO: 1277 - DNA, 19 bp, Artificial Sequence
  source: /note="Description of Artificial Sequence: Synthetic oligonucleotide"
catgctatgcaaatcctgc

SEQ ID NO: 1278 - DNA, 19 bp, Artificial Sequence
  source: /note="Description of Artificial Sequence: Synthetic oligonucleotide"
gctgtcacagaagctaatg

SEQ ID NO: 1279 - DNA, 19 bp, Artificial Sequence
  source: /note="Description of Artificial Sequence: Synthetic oligonucleotide"
ggacatatccattttgata

SEQ ID NO: 1280 - DNA, 19 bp, Artificial Sequence
  source: /note="Description of Artificial Sequence: Synthetic oligonucleotide"
aatgtcagtgtggtatctc

SEQ ID NO: 1281 - DNA, 19 bp, Artificial Sequence
  source: /note="Description of Artificial Sequence: Synthetic oligonucleotide"
tctctacaggatggaaaaa

SEQ ID NO: 1282 - DNA, 19 bp, Artificial Sequence
  source: /note="Description of Artificial Sequence: Synthetic oligonucleotide"
caagttcatgtacctgttt

SEQ ID NO: 1283 - DNA, 19 bp, Artificial Sequence
  source: /note="Description of Artificial Sequence: Synthetic oligonucleotide"
gcccaaactgtcagaaata

SEQ ID NO: 1284 - DNA, 19 bp, Artificial Sequence
  source: /note="Description of Artificial Sequence: Synthetic oligonucleotide"
cctggatgataacgctctg

SEQ ID NO: 1285 - DNA, 19 bp, Artificial Sequence
  source: /note="Description of Artificial Sequence: Synthetic oligonucleotide"
ctccacaatttcatcgatg

SEQ ID NO: 1286 - DNA, 19 bp, Artificial Sequence
  source: /note="Description of Artificial Sequence: Synthetic oligonucleotide"
caccttgtctctccttcag

SEQ ID NO: 1287 - DNA, 19 bp, Artificial Sequence
  source: /note="Description of Artificial Sequence: Synthetic oligonucleotide"
gactcagtacttccatagc

SEQ ID NO: 1288 - DNA, 19 bp, Artificial Sequence
  source: /note="Description of Artificial Sequence: Synthetic oligonucleotide"
tcctatgtgaggagtttcc

SEQ ID NO: 1289 - DNA, 19 bp, Artificial Sequence
  source: /note="Description of Artificial Sequence: Synthetic oligonucleotide"
ccacgagttaggagacttt

SEQ ID NO: 1290 - DNA, 19 bp, Artificial Sequence
  source: /note="Description of Artificial Sequence: Synthetic oligonucleotide"
ctttgtgatcctactcaat

SEQ ID NO: 1291 - DNA, 19 bp, Artificial Sequence
  source: /note="Description of Artificial Sequence: Synthetic oligonucleotide"
ggatgagcactcgacaagc

SEQ ID NO: 1292 - DNA, 19 bp, Artificial Sequence
  source: /note="Description of Artificial Sequence: Synthetic oligonucleotide"
agccttgctattcaacttc

SEQ ID NO: 1293 - DNA, 19 bp, Artificial Sequence
  source: /note="Description of Artificial Sequence: Synthetic oligonucleotide"
cttcctttctgcatgttcc

SEQ ID NO: 1294 - DNA, 19 bp, Artificial Sequence
  source: /note="Description of Artificial Sequence: Synthetic oligonucleotide"
ttcctgctatgttgggcta

SEQ ID NO: 1295 - DNA, 19 bp, Artificial Sequence
  source: /note="Description of Artificial Sequence: Synthetic oligonucleotide"
gctagcttttggcattttg

SEQ ID NO: 1296 - DNA, 19 bp, Artificial Sequence
  source: /note="Description of Artificial Sequence: Synthetic oligonucleotide"
caacaatttcgctccaaat

SEQ ID NO: 1297 - DNA, 19 bp, Artificial Sequence
  source: /note="Description of Artificial Sequence: Synthetic oligonucleotide"
ttatatttgcacttgctgg

SEQ ID NO: 1298 - DNA, 19 bp, Artificial Sequence
  source: /note="Description of Artificial Sequence: Synthetic oligonucleotide"
catgttcctctatatttct

SEQ ID NO: 1299 - DNA, 19 bp, Artificial Sequence
  source: /note="Description of Artificial Sequence: Synthetic oligonucleotide"
ctctggcagatatgtttcc

SEQ ID NO: 1300 - DNA, 19 bp, Artificial Sequence
  source: /note="Description of Artificial Sequence: Synthetic oligonucleotide"
tccagagatgaatgatatg

SEQ ID NO: 1301 - DNA, 19 bp, Artificial Sequence
  source: /note="Description of Artificial Sequence: Synthetic oligonucleotide"
tatgctgagagaaaaggta

SEQ ID NO: 1302 - DNA, 19 bp, Artificial Sequence
  source: /note="Description of Artificial Sequence: Synthetic oligonucleotide"
gtaactggaagaaaaaccg

SEQ ID NO: 1303 - DNA, 19 bp, Artificial Sequence
  source: /note="Description of Artificial Sequence: Synthetic oligonucleotide"
accgatttcaccttcttca

SEQ ID NO: 1304 - DNA, 19 bp, Artificial Sequence
  source: /note="Description of Artificial Sequence: Synthetic oligonucleotide"
aatgctggaatgttaactg

SEQ ID NO: 1305 - DNA, 19 bp, Artificial Sequence
  source: /note="Description of Artificial Sequence: Synthetic oligonucleotide"
cattctactcattaccttg

SEQ ID NO: 1306 - DNA, 19 bp, Artificial Sequence
  source: /note="Description of Artificial Sequence: Synthetic oligonucleotide"
cttgtatgcaggagaaatc

SEQ ID NO: 1307 - DNA, 19 bp, Artificial Sequence
  source: /note="Description of Artificial Sequence: Synthetic oligonucleotide"
attggagtaatagaaaatg

SEQ ID NO: 1308 - DNA, 19 bp, Artificial Sequence
  source: /note="Description of Artificial Sequence: Synthetic oligonucleotide"
atggtgttgttaataaagg

SEQ ID NO: 1309 - DNA, 19 bp, Artificial Sequence
  source: /note="Description of Artificial Sequence: Synthetic oligonucleotide"
aggcatttaatagataaaa

SEQ ID NO: 1310 - DNA, 19 bp, Artificial Sequence
  source: /note="Description of Artificial Sequence: Synthetic oligonucleotide"
catctccaaaaaggatttt

SEQ ID NO: 1311 - DNA, 19 bp, Artificial Sequence
  source: /note="Description of Artificial Sequence: Synthetic oligonucleotide"
ctgatcctatttagttaaa

SEQ ID NO: 1312 - DNA, 19 bp, Artificial Sequence
  source: /note="Description of Artificial Sequence: Synthetic oligonucleotide"
tgctttcaactgtaggtcc

SEQ ID NO: 1313 - DNA, 19 bp, Artificial Sequence
  source: /note="Description of Artificial Sequence: Synthetic oligonucleotide"
gtccagaaaactaattatt

SEQ ID NO: 1314 - DNA, 19 bp, Artificial Sequence
  source: /note="Description of Artificial Sequence: Synthetic oligonucleotide"
tcagtctgtgaaatagtcc

SEQ ID NO: 1315 - DNA, 19 bp, Artificial Sequence
  source: /note="Description of Artificial Sequence: Synthetic oligonucleotide"
gtccattatttgttgttaa

SEQ ID NO: 1316 - DNA, 19 bp, Artificial Sequence
  source: /note="Description of Artificial Sequence: Synthetic oligonucleotide"
ttaaaaatgcttcaaaagg

SEQ ID NO: 1317 - DNA, 19 bp, Artificial Sequence
  source: /note="Description of Artificial Sequence: Synthetic oligonucleotide"
ggttttcagtgtcagtctg

SEQ ID NO: 1318 - DNA, 19 bp, Artificial Sequence
  source: /note="Description of Artificial Sequence: Synthetic oligonucleotide"
tggtatataggagcctttg

SEQ ID NO: 1319 - DNA, 19 bp, Artificial Sequence
  source: /note="Description of Artificial Sequence: Synthetic oligonucleotide"
gggaaatacctatttttca

SEQ ID NO: 1320 - DNA, 19 bp, Artificial Sequence
  source: /note="Description of Artificial Sequence: Synthetic oligonucleotide"
tcagtattccatgcatatt

SEQ ID NO: 1321 - DNA, 19 bp, Artificial Sequence
  source: /note="Description of Artificial Sequence: Synthetic oligonucleotide"
caccatgaagcaagagaca

SEQ ID NO: 1322 - DNA, 19 bp, Artificial Sequence
  source: /note="Description of Artificial Sequence: Synthetic oligonucleotide"
gacatgcattctataatca

SEQ ID NO: 1323 - DNA, 19 bp, Artificial Sequence
  source: /note="Description of Artificial Sequence: Synthetic oligonucleotide"
tgtagacactcagactcag

SEQ ID NO: 1324 - DNA, 19 bp, Artificial Sequence
  source: /note="Description of Artificial Sequence: Synthetic oligonucleotide"
gggaaaatacaagttatat

SEQ ID NO: 1325 - DNA, 19 bp, Artificial Sequence
  source: /note="Description of Artificial Sequence: Synthetic oligonucleotide"
ctgaaagcctttaaaactc

SEQ ID NO: 1326 - DNA, 19 bp, Artificial Sequence
  source: /note="Description of Artificial Sequence: Synthetic oligonucleotide"
tggtaggatcaaagattca

SEQ ID NO: 1327 - DNA, 19 bp, Artificial Sequence
  source: /note="Description of Artificial Sequence: Synthetic oligonucleotide"
ttcaaatggtttcagagag

SEQ ID NO: 1328 - DNA, 19 bp, Artificial Sequence
  source: /note="Description of Artificial Sequence: Synthetic oligonucleotide"
gaggttttatttcaattaa

SEQ ID NO: 1329 - DNA, 19 bp, Artificial Sequence
  source: /note="Description of Artificial Sequence: Synthetic oligonucleotide"
tgttctagtgctttcaaga

SEQ ID NO: 1330 - DNA, 19 bp, Artificial Sequence
  source: /note="Description of Artificial Sequence: Synthetic oligonucleotide"
gagcaagtacatcaaaatg

SEQ ID NO: 1331 - DNA, 19 bp, Artificial Sequence
  source: /note="Description of Artificial Sequence: Synthetic oligonucleotide"
gtagaaggtaaaatgtatg

SEQ ID NO: 1332 - DNA, 19 bp, Artificial Sequence
  source: /note="Description of Artificial Sequence: Synthetic oligonucleotide"
gcaacactaatataaatta

SEQ ID NO: 1333 - DNA, 19 bp, Artificial Sequence
  source: /note="Description of Artificial Sequence: Synthetic oligonucleotide"
attccaagtctttaaggag

SEQ ID NO: 1334 - DNA, 19 bp, Artificial Sequence
  source: /note="Description of Artificial Sequence: Synthetic oligonucleotide"
ttctcacagctttttgttc

SEQ ID NO: 1335 - DNA, 19 bp, Artificial Sequence
  source: /note="Description of Artificial Sequence: Synthetic oligonucleotide"
tctgttttgtatttcaatt

SEQ ID NO: 1336 - DNA, 19 bp, Artificial Sequence
  source: /note="Description of Artificial Sequence: Synthetic oligonucleotide"
gaacttgcagtattatttt

SEQ ID NO: 1337 - DNA, 19 bp, Artificial Sequence
  source: /note="Description of Artificial Sequence: Synthetic oligonucleotide"
accattctaaaataatagg

SEQ ID NO: 1338 - DNA, 19 bp, Artificial Sequence
  source: /note="Description of Artificial Sequence: Synthetic oligonucleotide"
ggagttaggaaataaataa

SEQ ID NO: 1339 - DNA, 19 bp, Artificial Sequence
  source: /note="Description of Artificial Sequence: Synthetic oligonucleotide"
taaagttttgctagccctg

SEQ ID NO: 1340 - DNA, 19 bp, Artificial Sequence
  source: /note="Description of Artificial Sequence: Synthetic oligonucleotide"
ctgctaagttcaggcttag

SEQ ID NO: 1341 - DNA, 19 bp, Artificial Sequence
  source: /note="Description of Artificial Sequence: Synthetic oligonucleotide"
cgctaagtataaacttcac

SEQ ID NO: 1342 - DNA, 19 bp, Artificial Sequence
  source: /note="Description of Artificial Sequence: Synthetic oligonucleotide"
caccagattccacgaaaag

SEQ ID NO: 1343 - DNA, 19 bp, Artificial Sequence
  source: /note="Description of Artificial Sequence: Synthetic oligonucleotide"
ctgacttatgttgtggttg

SEQ ID NO: 1344 - DNA, 19 bp, Artificial Sequence
  source: /note="Description of Artificial Sequence: Synthetic oligonucleotide"
ctcacaaatggcagaacag

SEQ ID NO: 1345 - DNA, 19 bp, Artificial Sequence
  source: /note="Description of Artificial Sequence: Synthetic oligonucleotide"
gtatgtaaagctggtaaca

SEQ ID NO: 1346 - DNA, 19 bp, Artificial Sequence
  source: /note="Description of Artificial Sequence: Synthetic oligonucleotide"
aacacctcggtttcagtgc

SEQ ID NO: 1347 - DNA, 19 bp, Artificial Sequence
  source: /note="Description of Artificial Sequence: Synthetic oligonucleotide"
gcaccatgtgtttgctttg

SEQ ID NO: 1348 - DNA, 19 bp, Artificial Sequence
  source: /note="Description of Artificial Sequence: Synthetic oligonucleotide"
gaaggtgaagaatatgttg

SEQ ID NO: 1349 - DNA, 19 bp, Artificial Sequence
  source: /note="Description of Artificial Sequence: Synthetic oligonucleotide"
ggtttagagaaagaaattg

SEQ ID NO: 1350 - DNA, 19 bp, Artificial Sequence
  source: /note="Description of Artificial Sequence: Synthetic oligonucleotide"
attggatgtaattttatgc

SEQ ID NO: 1351 - DNA, 19 bp, Artificial Sequence
  source: /note="Description of Artificial Sequence: Synthetic oligonucleotide"
tgcaatttacttttaaaga

SEQ ID NO: 1352 - DNA, 19 bp, Artificial Sequence
  source: /note="Description of Artificial Sequence: Synthetic oligonucleotide"
gacaaacataactatttag

SEQ ID NO: 1353 - DNA, 19 bp, Artificial Sequence
  source: /note="Description of Artificial Sequence: Synthetic oligonucleotide"
gcagagaatattttaataa

SEQ ID NO: 1354 - DNA, 19 bp, Artificial Sequence
  source: /note="Description of Artificial Sequence: Synthetic oligonucleotide"
tgcaaaacaacagctggac

SEQ ID NO: 1355 - DNA, 19 bp, Artificial Sequence
  source: /note="Description of Artificial Sequence: Synthetic oligonucleotide"
actgctgtacatcaaggac

SEQ ID NO: 1356 - DNA, 19 bp, Artificial Sequence
  source: /note="Description of Artificial Sequence: Synthetic oligonucleotide"
gacagattaactggaaaac

SEQ ID NO: 1357 - DNA, 19 bp, Artificial Sequence
  source: /note="Description of Artificial Sequence: Synthetic oligonucleotide"
gttccttatgtgtgatcga

SEQ ID NO: 1358 - DNA, 19 bp, Artificial Sequence
  source: /note="Description of Artificial Sequence: Synthetic oligonucleotide"
tcagaaaagacttcctttg

SEQ ID NO: 1359 - DNA, 19 bp, Artificial Sequence
  source: /note="Description of Artificial Sequence: Synthetic oligonucleotide"
gcctatacttttccatatg

SEQ ID NO: 1360 - DNA, 19 bp, Artificial Sequence
  source: /note="Description of Artificial Sequence: Synthetic oligonucleotide"
tatggtataccttgaaaaa

SEQ ID NO: 1361 - DNA, 19 bp, Artificial Sequence
  source: /note="Description of Artificial Sequence: Synthetic oligonucleotide"
acaccatggttatttttct

SEQ ID NO: 1362 - DNA, 19 bp, Artificial Sequence
  source: /note="Description of Artificial Sequence: Synthetic oligonucleotide"
ctaccttttataaaagaca

SEQ ID NO: 1363 - DNA, 19 bp, Artificial Sequence
  source: /note="Description of Artificial Sequence: Synthetic oligonucleotide"
cctgtttactcatttagaa

SEQ ID NO: 1364 - DNA, 19 bp, Artificial Sequence
  source: /note="Description of Artificial Sequence: Synthetic oligonucleotide"
gaagatagagaaaattggt

SEQ ID NO: 1365 - DNA, 19 bp, Artificial Sequence
  source: /note="Description of Artificial Sequence: Synthetic oligonucleotide"
ggtctaaaattgaacatcc

SEQ ID NO: 1366 - DNA, 19 bp, Artificial Sequence
  source: /note="Description of Artificial Sequence: Synthetic oligonucleotide"
atcctagattcacactccc

SEQ ID NO: 1367 - DNA, 19 bp, Artificial Sequence
  source: /note="Description of Artificial Sequence: Synthetic oligonucleotide"
tcccaagtcacttaaggtg

SEQ ID NO: 1368 - DNA, 19 bp, Artificial Sequence
  source: /note="Description of Artificial Sequence: Synthetic oligonucleotide"
gaggaaaatgattgacaaa

SEQ ID NO: 1369 - DNA, 19 bp, Artificial Sequence
  source: /note="Description of Artificial Sequence: Synthetic oligonucleotide"
aaagcccaacaatgatctc

SEQ ID NO: 1370 - DNA, 19 bp, Artificial Sequence
  source: /note="Description of Artificial Sequence: Synthetic oligonucleotide"
tctcaggaattacattttc

SEQ ID NO: 1371 - DNA, 19 bp, Artificial Sequence
  source: /note="Description of Artificial Sequence: Synthetic oligonucleotide"
atgttttcatgtagcagca

SEQ ID NO: 1372 - DNA, 19 bp, Artificial Sequence
  source: /note="Description of Artificial Sequence: Synthetic oligonucleotide"
tgcagatttggtgaatatt

SEQ ID NO: 1373 - DNA, 19 bp, Artificial Sequence
  source: /note="Description of Artificial Sequence: Synthetic oligonucleotide"
cactttatgactgacaatt

SEQ ID NO: 1374 - DNA, 19 bp, Artificial Sequence
  source: /note="Description of Artificial Sequence: Synthetic oligonucleotide"
ggccaaatagtaaacaccc

SEQ ID NO: 1375 - RNA, 21 nt, Artificial Sequence
  source: /note="Description of Artificial Sequence: Synthetic oligonucleotide"
uuuucucuucaugguuucuca

SEQ ID NO: 1376 - RNA, 21 nt, Artificial Sequence
  source: /note="Description of Artificial Sequence: Synthetic oligonucleotide"
cagaagacaucuuuucucuua

SEQ ID NO: 1377 - RNA, 21 nt, Artificial Sequence
  source: /note="Description of Artificial Sequence: Synthetic oligonucleotide"
gaauaggugaaauuuguugua

SEQ ID NO: 1378 - RNA, 21 nt, Artificial Sequence
  source: /note="Description of Artificial Sequence: Synthetic oligonucleotide"
caucuuuucucuucaugguua

SEQ ID NO: 1379 - RNA, 21 nt, Artificial Sequence
  source: /note="Description of Artificial Sequence: Synthetic oligonucleotide"
uauguuuccagagaugaacga

SEQ ID NO: 1380 - RNA, 21 nt, Artificial Sequence
  source: /note="Description of Artificial Sequence: Synthetic oligonucleotide"
gacaucuuuucucuucaugga

SEQ ID NO: 1381 - RNA, 21 nt, Artificial Sequence
  source: /note="Description of Artificial Sequence: Synthetic oligonucleotide"
agacaucuuuucucuucauga

SEQ ID NO: 1382 - RNA, 21 nt, Artificial Sequence
  source: /note="Description of Artificial Sequence: Synthetic oligonucleotide"
aauaggugaaauuuguuguua

SEQ ID NO: 1383 - RNA, 21 nt, Artificial Sequence
  source: /note="Description of Artificial Sequence: Synthetic oligonucleotide"
ccuuaaaagguuuucgguuua

SEQ ID NO: 1384 - RNA, 21 nt, Artificial Sequence
  source: /note="Description of Artificial Sequence: Synthetic oligonucleotide"
uguuugguggauuuuacauga

SEQ ID NO: 1385 - RNA, 21 nt, Artificial Sequence
  source: /note="Description of Artificial Sequence: Synthetic oligonucleotide"
cgccauuuuccagcuuauuca

SEQ ID NO: 1386 - RNA, 21 nt, Artificial Sequence
  source: /note="Description of Artificial Sequence: Synthetic oligonucleotide"
ucuuuucucuucaugguuuca

SEQ ID NO: 1387 - RNA, 21 nt, Artificial Sequence
  source: /note="Description of Artificial Sequence: Synthetic oligonucleotide"
acaucuuuucucuucauggua

SEQ ID NO: 1388 - RNA, 21 nt, Artificial Sequence
  source: /note="Description of Artificial Sequence: Synthetic oligonucleotide"
cagaaacaucuccauagggaa

SEQ ID NO: 1389 - RNA, 21 nt, Artificial Sequence
  source: /note="Description of Artificial Sequence: Synthetic oligonucleotide"
ccauuuuccagcuuauuccaa

SEQ ID NO: 1390 - RNA, 21 nt, Artificial Sequence
  source: /note="Description of Artificial Sequence: Synthetic oligonucleotide"
cuguguuugguggauuuuaca

SEQ ID NO: 1391 - RNA, 21 nt, Artificial Sequence
  source: /note="Description of Artificial Sequence: Synthetic oligonucleotide"
auaggugaaauuuguuguuaa

SEQ ID NO: 1392 - RNA, 21 nt, Artificial Sequence
  source: /note="Description of Artificial Sequence: Synthetic oligonucleotide"
aagacaucuuuucucuucaua

SEQ ID NO: 1393 - RNA, 21 nt, Artificial Sequence
  source: /note="Description of Artificial Sequence: Synthetic oligonucleotide"
cugagagaaaaaguaacugga

SEQ ID NO: 1394 - RNA, 21 nt, Artificial Sequence
  source: /note="Description of Artificial Sequence: Synthetic oligonucleotide"
agaggcauuuggauuuaauca

SEQ ID NO: 1395 - RNA, 21 nt, Artificial Sequence
  source: /note="Description of Artificial Sequence: Synthetic oligonucleotide"
aaucuaaugacugguuucaga

SEQ ID NO: 1396 - RNA, 21 nt, Artificial Sequence
  source: /note="Description of Artificial Sequence: Synthetic oligonucleotide"
uagaauaggugaaauuuguua

SEQ ID NO: 1397 - RNA, 21 nt, Artificial Sequence
  source: /note="Description of Artificial Sequence: Synthetic oligonucleotide"
auuuuacaugcuuuucuuuga

SEQ ID NO: 1398 - RNA, 21 nt, Artificial Sequence
  source: /note="Description of Artificial Sequence: Synthetic oligonucleotide"
cuguaggauuguuuugaaaga

SEQ ID NO: 1399 - RNA, 21 nt, Artificial Sequence
  source: /note="Description of Artificial Sequence: Synthetic oligonucleotide"
guaacuggaagacaaacggaa

SEQ ID NO: 1400 - RNA, 21 nt, Artificial Sequence
  source: /note="Description of Artificial Sequence: Synthetic oligonucleotide"
ugcucaucaccuuguacgcaa

SEQ ID NO: 1401 - RNA, 21 nt, Artificial Sequence
  source: /note="Description of Artificial Sequence: Synthetic oligonucleotide"
aaugaccauacucacuucaga

SEQ ID NO: 1402 - RNA, 21 nt, Artificial Sequence
  source: /note="Description of Artificial Sequence: Synthetic oligonucleotide"
gaccuguaggauuguuuugaa

SEQ ID NO: 1403 - RNA, 21 nt, Artificial Sequence
  source: /note="Description of Artificial Sequence: Synthetic oligonucleotide"
agaauaggugaaauuuguuga

SEQ ID NO: 1404 - RNA, 21 nt, Artificial Sequence
  source: /note="Description of Artificial Sequence: Synthetic oligonucleotide"
gcuguguuugguggauuuuaa

SEQ ID NO: 1405 - RNA, 21 nt, Artificial Sequence
  source: /note="Description of Artificial Sequence: Synthetic oligonucleotide"
cccagauaaccagcucgaaca

SEQ ID NO: 1406 - RNA, 21 nt, Artificial Sequence
  source: /note="Description of Artificial Sequence: Synthetic oligonucleotide"
uggcgaccuguaggauuguua

SEQ ID NO: 1407 - RNA, 21 nt, Artificial Sequence
  source: /note="Description of Artificial Sequence: Synthetic oligonucleotide"
gaggcauuuggauuuaaucca

SEQ ID NO: 1408 - RNA, 21 nt, Artificial Sequence
  source: /note="Description of Artificial Sequence: Synthetic oligonucleotide"
auacucacuucaggaaugaua

SEQ ID NO: 1409 - RNA, 21 nt, Artificial Sequence
  source: /note="Description of Artificial Sequence: Synthetic oligonucleotide"
uccugggauugauuuuaacca

SEQ ID NO: 1410 - RNA, 21 nt, Artificial Sequence
  source: /note="Description of Artificial Sequence: Synthetic oligonucleotide"
uacucacuucaggaaugauga

SEQ ID NO: 1411 - RNA, 21 nt, Artificial Sequence
  source: /note="Description of Artificial Sequence: Synthetic oligonucleotide"
cggacacauccacuucgacaa

SEQ ID NO: 1412 - RNA, 21 nt, Artificial Sequence
  source: /note="Description of Artificial Sequence: Synthetic oligonucleotide"
uguagaauaggugaaauuuga

SEQ ID NO: 1413 - RNA, 21 nt, Artificial Sequence
  source: /note="Description of Artificial Sequence: Synthetic oligonucleotide"
acggacacauccacuucgaca

SEQ ID NO: 1414 - RNA, 21 nt, Artificial Sequence
  source: /note="Description of Artificial Sequence: Synthetic oligonucleotide"
auccacuucgacacugucaga

SEQ ID NO: 1415 - RNA, 21 nt, Artificial Sequence
  source: /note="Description of Artificial Sequence: Synthetic oligonucleotide"
cauuuuccagcuuauuccaga

SEQ ID NO: 1416 - RNA, 21 nt, Artificial Sequence
  source: /note="Description of Artificial Sequence: Synthetic oligonucleotide"
ugaggaguuuccucaugagua

SEQ ID NO: 1417 - RNA, 21 nt, Artificial Sequence
  source: /note="Description of Artificial Sequence: Synthetic oligonucleotide"
gcugagagaaaaaguaacuga

SEQ ID NO: 1418 - RNA, 21 nt, Artificial Sequence
  source: /note="Description of Artificial Sequence: Synthetic oligonucleotide"
cucuccugggauugauuuuaa

SEQ ID NO: 1419 - RNA, 21 nt, Artificial Sequence
  source: /note="Description of Artificial Sequence: Synthetic oligonucleotide"
uaaaagguuuucgguuucaga

SEQ ID NO: 1420 - RNA, 21 nt, Artificial Sequence
  source: /note="Description of Artificial Sequence: Synthetic oligonucleotide"
ugugaucuugcucaaugcaga

SEQ ID NO: 1421 - RNA, 21 nt, Artificial Sequence
  source: /note="Description of Artificial Sequence: Synthetic oligonucleotide"
cagaggcauuuggauuuaaua

SEQ ID NO: 1422 - RNA, 21 nt, Artificial Sequence
  source: /note="Description of Artificial Sequence: Synthetic oligonucleotide"
guagaauaggugaaauuugua

SEQ ID NO: 1423 - RNA, 21 nt, Artificial Sequence
  source: /note="Description of Artificial Sequence: Synthetic oligonucleotide"
augaccauacucacuucagga

SEQ ID NO: 1424 - RNA, 21 nt, Artificial Sequence
  source: /note="Description of Artificial Sequence: Synthetic oligonucleotide"
gacaugcugagagaaaaagua

SEQ ID NO: 1425 - RNA, 21 nt, Artificial Sequence
  source: /note="Description of Artificial Sequence: Synthetic oligonucleotide"
uuucucuggcagauauguuua

SEQ ID NO: 1426 - RNA, 21 nt, Artificial Sequence
  source: /note="Description of Artificial Sequence: Synthetic oligonucleotide"
cuccugggauugauuuuaaca

SEQ ID NO: 1427 - RNA, 21 nt, Artificial Sequence
  source: /note="Description of Artificial Sequence: Synthetic oligonucleotide"
uuauuccagaggcauuuggaa

SEQ ID NO: 1428 - RNA, 21 nt, Artificial Sequence
  source: /note="Description of Artificial Sequence: Synthetic oligonucleotide"
accuguaggauuguuuugaaa

SEQ ID NO: 1429 - RNA, 21 nt, Artificial Sequence
  source: /note="Description of Artificial Sequence: Synthetic oligonucleotide"
ugagcauaauuauuuagcaga

SEQ ID NO: 1430 - RNA, 21 nt, Artificial Sequence
  source: /note="Description of Artificial Sequence: Synthetic oligonucleotide"
uggauuuaaucccaaaauuga

SEQ ID NO: 1431 - RNA, 21 nt, Artificial Sequence
  source: /note="Description of Artificial Sequence: Synthetic oligonucleotide"
gugaucuugcucaaugcagga

SEQ ID NO: 1432 - RNA, 21 nt, Artificial Sequence
  source: /note="Description of Artificial Sequence: Synthetic oligonucleotide"
guguuugguggauuuuacaua

SEQ ID NO: 1433 - RNA, 21 nt, Artificial Sequence
  source: /note="Description of Artificial Sequence: Synthetic oligonucleotide"
gaguuuccucaugaguuagga

SEQ ID NO: 1434 - RNA, 21 nt, Artificial Sequence
  source: /note="Description of Artificial Sequence: Synthetic oligonucleotide"
ucuggcagauauguuuccaga

SEQ ID NO: 1435 - RNA, 21 nt, Artificial Sequence
  source: /note="Description of Artificial Sequence: Synthetic oligonucleotide"
aagcaguugcuguguuuggua

SEQ ID NO: 1436 - RNA, 21 nt, Artificial Sequence
  source: /note="Description of Artificial Sequence: Synthetic oligonucleotide"
augagcauaauuauuuagcaa

SEQ ID NO: 1437 - RNA, 21 nt, Artificial Sequence
  source: /note="Description of Artificial Sequence: Synthetic oligonucleotide"
cucaucaccuuguacgcagga

SEQ ID NO: 1438 - RNA, 21 nt, Artificial Sequence
  source: /note="Description of Artificial Sequence: Synthetic oligonucleotide"
aaaguaacaugaauuaggaaa

SEQ ID NO: 1439 - RNA, 21 nt, Artificial Sequence
  source: /note="Description of Artificial Sequence: Synthetic oligonucleotide"
cgaccuguaggauuguuuuga

SEQ ID NO: 1440 - RNA, 21 nt, Artificial Sequence
  source: /note="Description of Artificial Sequence: Synthetic oligonucleotide"
agcaguugcuguguuugguga

SEQ ID NO: 1441 - RNA, 21 nt, Artificial Sequence
  source: /note="Description of Artificial Sequence: Synthetic oligonucleotide"
ccugcucaucaccuuguacga

SEQ ID NO: 1442 - RNA, 21 nt, Artificial Sequence
  source: /note="Description of Artificial Sequence: Synthetic oligonucleotide"
gcucaucaccuuguacgcaga

SEQ ID NO: 1443 - RNA, 21 nt, Artificial Sequence
  source: /note="Description of Artificial Sequence: Synthetic oligonucleotide"
gaacacuuaagaugcuacuga

SEQ ID NO: 1444 - RNA, 21 nt, Artificial Sequence
  source: /note="Description of Artificial Sequence: Synthetic oligonucleotide"
ggcgaccuguaggauuguuua

SEQ ID NO: 1445 - RNA, 21 nt, Artificial Sequence
  source: /note="Description of Artificial Sequence: Synthetic oligonucleotide"
ucuccugggauugauuuuaaa

SEQ ID NO: 1446 - RNA, 21 nt, Artificial Sequence
  source: /note="Description of Artificial Sequence: Synthetic oligonucleotide"
uguguuugguggauuuuacaa

SEQ ID NO: 1447 - RNA, 21 nt, Artificial Sequence
  source: /note="Description of Artificial Sequence: Synthetic oligonucleotide"
ggacacauccacuucgacaca

SEQ ID NO: 1448 - RNA, 21 nt, Artificial Sequence
  source: /note="Description of Artificial Sequence: Synthetic oligonucleotide"
cugcucaucaccuuguacgca

SEQ ID NO: 1449 - RNA, 21 nt, Artificial Sequence
  source: /note="Description of Artificial Sequence: Synthetic oligonucleotide"
agcuuucggcauuuuggugga

SEQ ID NO: 1450 - RNA, 21 nt, Artificial Sequence
  source: /note="Description of Artificial Sequence: Synthetic oligonucleotide"
uucucuggcagauauguuuca

SEQ ID NO: 1451 - RNA, 21 nt, Artificial Sequence
  source: /note="Description of Artificial Sequence: Synthetic oligonucleotide"
cccaaacugucagaaauagga

SEQ ID NO: 1452 - RNA, 21 nt, Artificial Sequence
  source: /note="Description of Artificial Sequence: Synthetic oligonucleotide"
aguaacuggaagacaaacgga

SEQ ID NO: 1453 - RNA, 21 nt, Artificial Sequence
  source: /note="Description of Artificial Sequence: Synthetic oligonucleotide"
ucucuccugggauugauuuua

SEQ ID NO: 1454 - RNA, 21 nt, Artificial Sequence
  source: /note="Description of Artificial Sequence: Synthetic oligonucleotide"
ucaccuucuucaugauccaga

SEQ ID NO: 1455 - RNA, 21 nt, Artificial Sequence
  source: /note="Description of Artificial Sequence: Synthetic oligonucleotide"
cucuggcagauauguuuccaa

SEQ ID NO: 1456 - RNA, 21 nt, Artificial Sequence
  source: /note="Description of Artificial Sequence: Synthetic oligonucleotide"
uagcuuucggcauuuugguga

SEQ ID NO: 1457 - RNA, 21 nt, Artificial Sequence
  source: /note="Description of Artificial Sequence: Synthetic oligonucleotide"
aaguaacuggaagacaaacga

SEQ ID NO: 1458 - RNA, 21 nt, Artificial Sequence
  source: /note="Description of Artificial Sequence: Synthetic oligonucleotide"
ucucuggcagauauguuucca

SEQ ID NO: 1459 - RNA, 21 nt, Artificial Sequence
  source: /note="Description of Artificial Sequence: Synthetic oligonucleotide"
ccagaggcauuuggauuuaaa

SEQ ID NO: 1460 - RNA, 21 nt, Artificial Sequence
  source: /note="Description of Artificial Sequence: Synthetic oligonucleotide"
ugugucagagacugaugguga

SEQ ID NO: 1461 - RNA, 21 nt, Artificial Sequence
  source: /note="Description of Artificial Sequence: Synthetic oligonucleotide"
cugugucagagacugauggua

SEQ ID NO: 1462 - RNA, 21 nt, Artificial Sequence
  source: /note="Description of Artificial Sequence: Synthetic oligonucleotide"
gaugagcauaauuauuuagca

SEQ ID NO: 1463 - RNA, 21 nt, Artificial Sequence
  source: /note="Description of Artificial Sequence: Synthetic oligonucleotide"
gugaggaguuuccucaugaga

SEQ ID NO: 1464 - RNA, 21 nt, Artificial Sequence
  source: /note="Description of Artificial Sequence: Synthetic oligonucleotide"
ggaguuuccucaugaguuaga

SEQ ID NO: 1465 - RNA, 23 nt, Artificial Sequence
  source: /note="Description of Artificial Sequence: Synthetic oligonucleotide"
ugagaaaccaugaagagaaaaga

SEQ ID NO: 1466 - RNA, 23 nt, Artificial Sequence
  source: /note="Description of Artificial Sequence: Synthetic oligonucleotide"
uaagagaaaagaugucuucugcu

SEQ ID NO: 1467 - RNA, 23 nt, Artificial Sequence
  source: /note="Description of Artificial Sequence: Synthetic oligonucleotide"
uacaacaaauuucaccuauucua

SEQ ID NO: 1468 - RNA, 23 nt, Artificial Sequence
  source: /note="Description of Artificial Sequence: Synthetic oligonucleotide"
uaaccaugaagagaaaagauguc

SEQ ID NO: 1469 - RNA, 23 nt, Artificial Sequence
  source: /note="Description of Artificial Sequence: Synthetic oligonucleotide"
ucguucaucucuggaaacauauc

SEQ ID NO: 1470 - RNA, 23 nt, Artificial Sequence
  source: /note="Description of Artificial Sequence: Synthetic oligonucleotide"
uccaugaagagaaaagaugucuu

SEQ ID NO: 1471 - RNA, 23 nt, Artificial Sequence
  source: /note="Description of Artificial Sequence: Synthetic oligonucleotide"
ucaugaagagaaaagaugucuuc

SEQ ID NO: 1472 - RNA, 23 nt, Artificial Sequence
  source: /note="Description of Artificial Sequence: Synthetic oligonucleotide"
uaacaacaaauuucaccuauucu

SEQ ID NO: 1473 - RNA, 23 nt, Artificial Sequence
  source: /note="Description of Artificial Sequence: Synthetic oligonucleotide"
uaaaccgaaaaccuuuuaaggaa

SEQ ID NO: 1474 - RNA, 23 nt, Artificial Sequence
  source: /note="Description of Artificial Sequence: Synthetic oligonucleotide"
ucauguaaaauccaccaaacaca

SEQ ID NO: 1475 - RNA, 23 nt, Artificial Sequence
  source: /note="Description of Artificial Sequence: Synthetic oligonucleotide"
ugaauaagcuggaaaauggcguu

SEQ ID NO: 1476 - RNA, 23 nt, Artificial Sequence
  source: /note="Description of Artificial Sequence: Synthetic oligonucleotide"
ugaaaccaugaagagaaaagaug

SEQ ID NO: 1477 - RNA, 23 nt, Artificial Sequence
  source: /note="Description of Artificial Sequence: Synthetic oligonucleotide"
uaccaugaagagaaaagaugucu

SEQ ID NO: 1478 - RNA, 23 nt, Artificial Sequence
  source: /note="Description of Artificial Sequence: Synthetic oligonucleotide"
uucccuauggagauguuucugug

SEQ ID NO: 1479 - RNA, 23 nt, Artificial Sequence
  source: /note="Description of Artificial Sequence: Synthetic oligonucleotide"
uuggaauaagcuggaaaauggcg

SEQ ID NO: 1480 - RNA, 23 nt, Artificial Sequence
  source: /note="Description of Artificial Sequence: Synthetic oligonucleotide"
uguaaaauccaccaaacacagca

SEQ ID NO: 1481 - RNA, 23 nt, Artificial Sequence
  source: /note="Description of Artificial Sequence: Synthetic oligonucleotide"
uuaacaacaaauuucaccuauuc

SEQ ID NO: 1482 - RNA, 23 nt, Artificial Sequence
  source: /note="Description of Artificial Sequence: Synthetic oligonucleotide"
uaugaagagaaaagaugucuucu

SEQ ID NO: 1483 - RNA, 23 nt, Artificial Sequence
  source: /note="Description of Artificial Sequence: Synthetic oligonucleotide"
uccaguuacuuuuucucucagca

SEQ ID NO: 1484 - RNA, 23 nt, Artificial Sequence
  source: /note="Description of Artificial Sequence: Synthetic oligonucleotide"
ugauuaaauccaaaugccucugg

SEQ ID NO: 1485 - RNA, 23 nt, Artificial Sequence
  source: /note="Description of Artificial Sequence: Synthetic oligonucleotide"
ucugaaaccagucauuagauucc

SEQ ID NO: 1486 - RNA, 23 nt, Artificial Sequence
  source: /note="Description of Artificial Sequence: Synthetic oligonucleotide"
uaacaaauuucaccuauucuaca

SEQ ID NO: 1487 - RNA, 23 nt, Artificial Sequence
  source: /note="Description of Artificial Sequence: Synthetic oligonucleotide"
ucaaagaaaagcauguaaaaucc

SEQ ID NO: 1488 - RNA, 23 nt, Artificial Sequence
  source: /note="Description of Artificial Sequence: Synthetic oligonucleotide"
ucuuucaaaacaauccuacaggu

SEQ ID NO: 1489 - RNA, 23 nt, Artificial Sequence
  source: /note="Description of Artificial Sequence: Synthetic oligonucleotide"
uuccguuugucuuccaguuacuu

SEQ ID NO: 1490 - RNA, 23 nt, Artificial Sequence
  source: /note="Description of Artificial Sequence: Synthetic oligonucleotide"
uugcguacaaggugaugagcagg

SEQ ID NO: 1491 - RNA, 23 nt, Artificial Sequence
  source: /note="Description of Artificial Sequence: Synthetic oligonucleotide"
ucugaagugaguauggucauucu

SEQ ID NO: 1492 - RNA, 23 nt, Artificial Sequence
  source: /note="Description of Artificial Sequence: Synthetic oligonucleotide"
uucaaaacaauccuacaggucgc

SEQ ID NO: 1493 - RNA, 23 nt, Artificial Sequence
  source: /note="Description of Artificial Sequence: Synthetic oligonucleotide"
ucaacaaauuucaccuauucuac

SEQ ID NO: 1494 - RNA, 23 nt, Artificial Sequence
  source: /note="Description of Artificial Sequence: Synthetic oligonucleotide"
uuaaaauccaccaaacacagcaa

SEQ ID NO: 1495 - RNA, 23 nt, Artificial Sequence
  source: /note="Description of Artificial Sequence: Synthetic oligonucleotide"
uguucgagcugguuaucugggug

SEQ ID NO: 1496 - RNA, 23 nt, Artificial Sequence
  source: /note="Description of Artificial Sequence: Synthetic oligonucleotide"
uaacaauccuacaggucgccaac

SEQ ID NO: 1497 - RNA, 23 nt, Artificial Sequence
  source: /note="Description of Artificial Sequence: Synthetic oligonucleotide"
uggauuaaauccaaaugccucug

SEQ ID NO: 1498 - RNA, 23 nt, Artificial Sequence
  source: /note="Description of Artificial Sequence: Synthetic oligonucleotide"
uaucauuccugaagugaguaugg

SEQ ID NO: 1499 - RNA, 23 nt, Artificial Sequence
  source: /note="Description of Artificial Sequence: Synthetic oligonucleotide"
ugguuaaaaucaaucccaggaga

SEQ ID NO: 1500 - RNA, 23 nt, Artificial Sequence
  source: /note="Description of Artificial Sequence: Synthetic oligonucleotide"
ucaucauuccugaagugaguaug

SEQ ID NO: 1501 - RNA, 23 nt, Artificial Sequence
  source: /note="Description of Artificial Sequence: Synthetic oligonucleotide"
uugucgaaguggauguguccguu

SEQ ID NO: 1502 - RNA, 23 nt, Artificial Sequence
  source: /note="Description of Artificial Sequence: Synthetic oligonucleotide"
ucaaauuucaccuauucuacaua

SEQ ID NO: 1503 - RNA, 23 nt, Artificial Sequence
  source: /note="Description of Artificial Sequence: Synthetic oligonucleotide"
ugucgaaguggauguguccguua

SEQ ID NO: 1504 - RNA, 23 nt, Artificial Sequence
  source: /note="Description of Artificial Sequence: Synthetic oligonucleotide"
ucugacagugucgaaguggaugu

SEQ ID NO: 1505 - RNA, 23 nt, Artificial Sequence
  source: /note="Description of Artificial Sequence: Synthetic oligonucleotide"
ucuggaauaagcuggaaaauggc

SEQ ID NO: 1506 - RNA, 23 nt, Artificial Sequence
  source: /note="Description of Artificial Sequence: Synthetic oligonucleotide"
uacucaugaggaaacuccucaca

SEQ ID NO: 1507 - RNA, 23 nt, Artificial Sequence
  source: /note="Description of Artificial Sequence: Synthetic oligonucleotide"
ucaguuacuuuuucucucagcau

SEQ ID NO: 1508 - RNA, 23 nt, Artificial Sequence
  source: /note="Description of Artificial Sequence: Synthetic oligonucleotide"
uuaaaaucaaucccaggagagag

SEQ ID NO: 1509 - RNA, 23 nt, Artificial Sequence
  source: /note="Description of Artificial Sequence: Synthetic oligonucleotide"
ucugaaaccgaaaaccuuuuaag

SEQ ID NO: 1510 - RNA, 23 nt, Artificial Sequence
  source: /note="Description of Artificial Sequence: Synthetic oligonucleotide"
ucugcauugagcaagaucacaaa

SEQ ID NO: 1511 - RNA, 23 nt, Artificial Sequence
  source: /note="Description of Artificial Sequence: Synthetic oligonucleotide"
uauuaaauccaaaugccucugga

SEQ ID NO: 1512 - RNA, 23 nt, Artificial Sequence
  source: /note="Description of Artificial Sequence: Synthetic oligonucleotide"
uacaaauuucaccuauucuacau

SEQ ID NO: 1513 - RNA, 23 nt, Artificial Sequence
  source: /note="Description of Artificial Sequence: Synthetic oligonucleotide"
uccugaagugaguauggucauuc

SEQ ID NO: 1514 - RNA, 23 nt, Artificial Sequence
  source: /note="Description of Artificial Sequence: Synthetic oligonucleotide"
uacuuuuucucucagcaugucgu

SEQ ID NO: 1515 - RNA, 23 nt, Artificial Sequence
  source: /note="Description of Artificial Sequence: Synthetic oligonucleotide"
uaaacauaucugccagagaaaug

SEQ ID NO: 1516 - RNA, 23 nt, Artificial Sequence
  source: /note="Description of Artificial Sequence: Synthetic oligonucleotide"
uguuaaaaucaaucccaggagag

SEQ ID NO: 1517 - RNA, 23 nt, Artificial Sequence
  source: /note="Description of Artificial Sequence: Synthetic oligonucleotide"
uuccaaaugccucuggaauaagc

SEQ ID NO: 1518 - RNA, 23 nt, Artificial Sequence
  source: /note="Description of Artificial Sequence: Synthetic oligonucleotide"
uuucaaaacaauccuacaggucg

SEQ ID NO: 1519 - RNA, 23 nt, Artificial Sequence
  source: /note="Description of Artificial Sequence: Synthetic oligonucleotide"
ucugcuaaauaauuaugcucauc

SEQ ID NO: 1520 - RNA, 23 nt, Artificial Sequence
  source: /note="Description of Artificial Sequence: Synthetic oligonucleotide"
ucaauuuugggauuaaauccaaa

SEQ ID NO: 1521 - RNA, 23 nt, Artificial Sequence
  source: /note="Description of Artificial Sequence: Synthetic oligonucleotide"
uccugcauugagcaagaucacaa

SEQ ID NO: 1522 - RNA, 23 nt, Artificial Sequence
  source: /note="Description of Artificial Sequence: Synthetic oligonucleotide"
uauguaaaauccaccaaacacag

SEQ ID NO: 1523 - RNA, 23 nt, Artificial Sequence
  source: /note="Description of Artificial Sequence: Synthetic oligonucleotide"
uccuaacucaugaggaaacuccu

SEQ ID NO: 1524 - RNA, 23 nt, Artificial Sequence
  source: /note="Description of Artificial Sequence: Synthetic oligonucleotide"
ucuggaaacauaucugccagaga

SEQ ID NO: 1525 - RNA, 23 nt, Artificial Sequence
  source: /note="Description of Artificial Sequence: Synthetic oligonucleotide"
uaccaaacacagcaacugcuuuc

SEQ ID NO: 1526 - RNA, 23 nt, Artificial Sequence
  source: /note="Description of Artificial Sequence: Synthetic oligonucleotide"
uugcuaaauaauuaugcucaucu

SEQ ID NO: 1527 - RNA, 23 nt, Artificial Sequence
  source: /note="Description of Artificial Sequence: Synthetic oligonucleotide"
uccugcguacaaggugaugagca

SEQ ID NO: 1528 - RNA, 23 nt, Artificial Sequence
  source: /note="Description of Artificial Sequence: Synthetic oligonucleotide"
uuuccuaauucauguuacuuugu

SEQ ID NO: 1529 - RNA, 23 nt, Artificial Sequence
  source: /note="Description of Artificial Sequence: Synthetic oligonucleotide"
ucaaaacaauccuacaggucgcc

SEQ ID NO: 1530 - RNA, 23 nt, Artificial Sequence
  source: /note="Description of Artificial Sequence: Synthetic oligonucleotide"
ucaccaaacacagcaacugcuuu

SEQ ID NO: 1531 - RNA, 23 nt, Artificial Sequence
  source: /note="Description of Artificial Sequence: Synthetic oligonucleotide"
ucguacaaggugaugagcaggau

SEQ ID NO: 1532 - RNA, 23 nt, Artificial Sequence
  source: /note="Description of Artificial Sequence: Synthetic oligonucleotide"
ucugcguacaaggugaugagcag

SEQ ID NO: 1533 - RNA, 23 nt, Artificial Sequence
  source: /note="Description of Artificial Sequence: Synthetic oligonucleotide"
ucaguagcaucuuaaguguucuc

SEQ ID NO: 1534 - RNA, 23 nt, Artificial Sequence
  source: /note="Description of Artificial Sequence: Synthetic oligonucleotide"
uaaacaauccuacaggucgccaa

SEQ ID NO: 1535 - RNA, 23 nt, Artificial Sequence
  source: /note="Description of Artificial Sequence: Synthetic oligonucleotide"
uuuaaaaucaaucccaggagaga

SEQ ID NO: 1536 - RNA, 23 nt, Artificial Sequence
  source: /note="Description of Artificial Sequence: Synthetic oligonucleotide"
uuguaaaauccaccaaacacagc

SEQ ID NO: 1537 - RNA, 23 nt, Artificial Sequence
  source: /note="Description of Artificial Sequence: Synthetic oligonucleotide"
ugugucgaaguggauguguccgu

SEQ ID NO: 1538 - RNA, 23 nt, Artificial Sequence
  source: /note="Description of Artificial Sequence: Synthetic oligonucleotide"
ugcguacaaggugaugagcagga

SEQ ID NO: 1539 - RNA, 23 nt, Artificial Sequence
  source: /note="Description of Artificial Sequence: Synthetic oligonucleotide"
uccaccaaaaugccgaaagcuag

SEQ ID NO: 1540 - RNA, 23 nt, Artificial Sequence
  source: /note="Description of Artificial Sequence: Synthetic oligonucleotide"
ugaaacauaucugccagagaaau

SEQ ID NO: 1541 - RNA, 23 nt, Artificial Sequence
  source: /note="Description of Artificial Sequence: Synthetic oligonucleotide"
uccuauuucugacaguuugggcc

SEQ ID NO: 1542 - RNA, 23 nt, Artificial Sequence
  source: /note="Description of Artificial Sequence: Synthetic oligonucleotide"
uccguuugucuuccaguuacuuu

SEQ ID NO: 1543 - RNA, 23 nt, Artificial Sequence
  source: /note="Description of Artificial Sequence: Synthetic oligonucleotide"
uaaaaucaaucccaggagagagg

SEQ ID NO: 1544 - RNA, 23 nt, Artificial Sequence
  source: /note="Description of Artificial Sequence: Synthetic oligonucleotide"
ucuggaucaugaagaaggugaaa

SEQ ID NO: 1545 - RNA, 23 nt, Artificial Sequence
  source: /note="Description of Artificial Sequence: Synthetic oligonucleotide"
uuggaaacauaucugccagagaa

SEQ ID NO: 1546 - RNA, 23 nt, Artificial Sequence
  source: /note="Description of Artificial Sequence: Synthetic oligonucleotide"
ucaccaaaaugccgaaagcuagu

SEQ ID NO: 1547 - RNA, 23 nt, Artificial Sequence
  source: /note="Description of Artificial Sequence: Synthetic oligonucleotide"
ucguuugucuuccaguuacuuuu

SEQ ID NO: 1548 - RNA, 23 nt, Artificial Sequence
  source: /note="Description of Artificial Sequence: Synthetic oligonucleotide"
uggaaacauaucugccagagaaa

SEQ ID NO: 1549 - RNA, 23 nt, Artificial Sequence
  source: /note="Description of Artificial Sequence: Synthetic oligonucleotide"
uuuaaauccaaaugccucuggaa

SEQ ID NO: 1550 - RNA, 23 nt, Artificial Sequence
  source: /note="Description of Artificial Sequence: Synthetic oligonucleotide"
ucaccaucagucucugacacagc

SEQ ID NO: 1551 - RNA, 23 nt, Artificial Sequence
  source: /note="Description of Artificial Sequence: Synthetic oligonucleotide"
uaccaucagucucugacacagcc

SEQ ID NO: 1552 - RNA, 23 nt, Artificial Sequence
  source: /note="Description of Artificial Sequence: Synthetic oligonucleotide"
ugcuaaauaauuaugcucaucuu

SEQ ID NO: 1553 - RNA, 23 nt, Artificial Sequence
  source: /note="Description of Artificial Sequence: Synthetic oligonucleotide"
ucucaugaggaaacuccucacac

SEQ ID NO: 1554 - RNA, 23 nt, Artificial Sequence
  source: /note="Description of Artificial Sequence: Synthetic oligonucleotide"
ucuaacucaugaggaaacuccuc

SEQ ID NO: 1555 - RNA, 21 nt, Artificial Sequence
  source: /note="Description of Artificial Sequence: Synthetic oligonucleotide"
uuuucucuucaugguuucuca

SEQ ID NO: 1556 - RNA, 21 nt, Artificial Sequence
  source: /note="Description of Artificial Sequence: Synthetic oligonucleotide"
cagaagacaucuuuucucuua

SEQ ID NO: 1557 - RNA, 21 nt, Artificial Sequence
  source: /note="Description of Artificial Sequence: Synthetic oligonucleotide"
gaauaggugaaauuuguugua

SEQ ID NO: 1558 - RNA, 21 nt, Artificial Sequence
  source: /note="Description of Artificial Sequence: Synthetic oligonucleotide"
caucuuuucucuucaugguua

SEQ ID NO: 1559 - RNA, 21 nt, Artificial Sequence
  source: /note="Description of Artificial Sequence: Synthetic oligonucleotide"
uauguuuccagagaugaacga

SEQ ID NO: 1560 - RNA, 21 nt, Artificial Sequence
  source: /note="Description of Artificial Sequence: Synthetic oligonucleotide"
gacaucuuuucucuucaugga

SEQ ID NO: 1561 - RNA, 21 nt, Artificial Sequence
  source: /note="Description of Artificial Sequence: Synthetic oligonucleotide"
agacaucuuuucucuucauga

SEQ ID NO: 1562 - RNA, 21 nt, Artificial Sequence
  source: /note="Description of Artificial Sequence: Synthetic oligonucleotide"
aauaggugaaauuuguuguua

SEQ ID NO: 1563 - RNA, 21 nt, Artificial Sequence
  source: /note="Description of Artificial Sequence: Synthetic oligonucleotide"
ccuuaaaagguuuucgguuua

SEQ ID NO: 1564 - RNA, 21 nt, Artificial Sequence
  source: /note="Description of Artificial Sequence: Synthetic oligonucleotide"
uguuugguggauuuuacauga

SEQ ID NO: 1565 - RNA, 21 nt, Artificial Sequence
  source: /note="Description of Artificial Sequence: Synthetic oligonucleotide"
cgccauuuuccagcuuauuca

SEQ ID NO: 1566 - RNA, 21 nt, Artificial Sequence
  source: /note="Description of Artificial Sequence: Synthetic oligonucleotide"
ucuuuucucuucaugguuuca

SEQ ID NO: 1567 - RNA, 21 nt, Artificial Sequence
  source: /note="Description of Artificial Sequence: Synthetic oligonucleotide"
acaucuuuucucuucauggua

SEQ ID NO: 1568 - RNA, 21 nt, Artificial Sequence
  source: /note="Description of Artificial Sequence: Synthetic oligonucleotide"
cagaaacaucuccauagggaa

SEQ ID NO: 1569 - RNA, 21 nt, Artificial Sequence
  source: /note="Description of Artificial Sequence: Synthetic oligonucleotide"
ccauuuuccagcuuauuccaa

SEQ ID NO: 1570 - RNA, 21 nt, Artificial Sequence
  source: /note="Description of Artificial Sequence: Synthetic oligonucleotide"
cuguguuugguggauuuuaca

SEQ ID NO: 1571 - RNA, 21 nt, Artificial Sequence
  source: /note="Description of Artificial Sequence: Synthetic oligonucleotide"
auaggugaaauuuguuguuaa

SEQ ID NO: 1572 - RNA, 21 nt, Artificial Sequence
  source: /note="Description of Artificial Sequence: Synthetic oligonucleotide"
aagacaucuuuucucuucaua

SEQ ID NO: 1573 - RNA, 21 nt, Artificial Sequence
  source: /note="Description of Artificial Sequence: Synthetic oligonucleotide"
cugagagaaaaaguaacugga

SEQ ID NO: 1574 - RNA, 21 nt, Artificial Sequence
  source: /note="Description of Artificial Sequence: Synthetic oligonucleotide"
agaggcauuuggauuuaauca

SEQ ID NO: 1575 - RNA, 21 nt, Artificial Sequence
  source: /note="Description of Artificial Sequence: Synthetic oligonucleotide"
aaucuaaugacugguuucaga

SEQ ID NO: 1576 - RNA, 21 nt, Artificial Sequence
  source: /note="Description of Artificial Sequence: Synthetic oligonucleotide"
uagaauaggugaaauuuguua

SEQ ID NO: 1577 - RNA, 21 nt, Artificial Sequence
  source: /note="Description of Artificial Sequence: Synthetic oligonucleotide"
auuuuacaugcuuuucuuuga

SEQ ID NO: 1578 - RNA, 21 nt, Artificial Sequence
  source: /note="Description of Artificial Sequence: Synthetic oligonucleotide"
cuguaggauuguuuugaaaga

SEQ ID NO: 1579 - RNA, 21 nt, Artificial Sequence
  source: /note="Description of Artificial Sequence: Synthetic oligonucleotide"
guaacuggaagacaaacggaa

SEQ ID NO: 1580 - RNA, 21 nt, Artificial Sequence
  source: /note="Description of Artificial Sequence: Synthetic oligonucleotide"
ugcucaucaccuuguacgcaa

SEQ ID NO: 1581 - RNA, 21 nt, Artificial Sequence
  source: /note="Description of Artificial Sequence: Synthetic oligonucleotide"
aaugaccauacucacuucaga

SEQ ID NO: 1582 - RNA, 21 nt, Artificial Sequence
  source: /note="Description of Artificial Sequence: Synthetic oligonucleotide"
gaccuguaggauuguuuugaa

SEQ ID NO: 1583 - RNA, 21 nt, Artificial Sequence
  source: /note="Description of Artificial Sequence: Synthetic oligonucleotide"
agaauaggugaaauuuguuga

SEQ ID NO: 1584 - RNA, 21 nt, Artificial Sequence
  source: /note="Description of Artificial Sequence: Synthetic oligonucleotide"
gcuguguuugguggauuuuaa

SEQ ID NO: 1585 - RNA, 21 nt, Artificial Sequence
  source: /note="Description of Artificial Sequence: Synthetic oligonucleotide"
cccagauaaccagcucgaaca

SEQ ID NO: 1586 - RNA, 21 nt, Artificial Sequence
  source: /note="Description of Artificial Sequence: Synthetic oligonucleotide"
uggcgaccuguaggauuguua

SEQ ID NO: 1587 - RNA, 21 nt, Artificial Sequence
  source: /note="Description of Artificial Sequence: Synthetic oligonucleotide"
gaggcauuuggauuuaaucca

SEQ ID NO: 1588 - RNA, 21 nt, Artificial Sequence
  source: /note="Description of Artificial Sequence: Synthetic oligonucleotide"
auacucacuucaggaaugaua

SEQ ID NO: 1589 - RNA, 21 nt, Artificial Sequence
  source: /note="Description of Artificial Sequence: Synthetic oligonucleotide"
uccugggauugauuuuaacca

SEQ ID NO: 1590 - RNA, 21 nt, Artificial Sequence
  source: /note="Description of Artificial Sequence: Synthetic oligonucleotide"
uacucacuucaggaaugauga

SEQ ID NO: 1591 - RNA, 21 nt, Artificial Sequence
  source: /note="Description of Artificial Sequence: Synthetic oligonucleotide"
cggacacauccacuucgacaa

SEQ ID NO: 1592 - RNA, 21 nt, Artificial Sequence
  source: /note="Description of Artificial Sequence: Synthetic oligonucleotide"
uguagaauaggugaaauuuga

SEQ ID NO: 1593 - RNA, 21 nt, Artificial Sequence
  source: /note="Description of Artificial Sequence: Synthetic oligonucleotide"
acggacacauccacuucgaca

SEQ ID NO: 1594 - RNA, 21 nt, Artificial Sequence
  source: /note="Description of Artificial Sequence: Synthetic oligonucleotide"
auccacuucgacacugucaga

SEQ ID NO: 1595 - RNA, 21 nt, Artificial Sequence
  source: /note="Description of Artificial Sequence: Synthetic oligonucleotide"
cauuuuccagcuuauuccaga

SEQ ID NO: 1596 - RNA, 21 nt, Artificial Sequence
  source: /note="Description of Artificial Sequence: Synthetic oligonucleotide"
ugaggaguuuccucaugagua

SEQ ID NO: 1597 - RNA, 21 nt, Artificial Sequence
  source: /note="Description of Artificial Sequence: Synthetic oligonucleotide"
gcugagagaaaaaguaacuga

SEQ ID NO: 1598 - RNA, 21 nt, Artificial Sequence
  source: /note="Description of Artificial Sequence: Synthetic oligonucleotide"
cucuccugggauugauuuuaa

SEQ ID NO: 1599 - RNA, 21 nt, Artificial Sequence
  source: /note="Description of Artificial Sequence: Synthetic oligonucleotide"
uaaaagguuuucgguuucaga

SEQ ID NO: 1600 - RNA, 21 nt, Artificial Sequence
  source: /note="Description of Artificial Sequence: Synthetic oligonucleotide"
ugugaucuugcucaaugcaga

SEQ ID NO: 1601 - RNA, 21 nt, Artificial Sequence
  source: /note="Description of Artificial Sequence: Synthetic oligonucleotide"
cagaggcauuuggauuuaaua

SEQ ID NO: 1602 - RNA, 21 nt, Artificial Sequence
  source: /note="Description of Artificial Sequence: Synthetic oligonucleotide"
guagaauaggugaaauuugua

SEQ ID NO: 1603 - RNA, 21 nt, Artificial Sequence
  source: /note="Description of Artificial Sequence: Synthetic oligonucleotide"
augaccauacucacuucagga

SEQ ID NO: 1604 - RNA, 21 nt, Artificial Sequence
  source: /note="Description of Artificial Sequence: Synthetic oligonucleotide"
gacaugcugagagaaaaagua

SEQ ID NO: 1605 - RNA, 21 nt, Artificial Sequence
  source: /note="Description of Artificial Sequence: Synthetic oligonucleotide"
uuucucuggcagauauguuua

SEQ ID NO: 1606 - RNA, 21 nt, Artificial Sequence
  source: /note="Description of Artificial Sequence: Synthetic oligonucleotide"
cuccugggauugauuuuaaca

SEQ ID NO: 1607 - RNA, 21 nt, Artificial Sequence
  source: /note="Description of Artificial Sequence: Synthetic oligonucleotide"
uuauuccagaggcauuuggaa

SEQ ID NO: 1608 - RNA, 21 nt, Artificial Sequence
  source: /note="Description of Artificial Sequence: Synthetic oligonucleotide"
accuguaggauuguuuugaaa

SEQ ID NO: 1609 - RNA, 21 nt, Artificial Sequence
  source: /note="Description of Artificial Sequence: Synthetic oligonucleotide"
ugagcauaauuauuuagcaga

SEQ ID NO: 1610 - RNA, 21 nt, Artificial Sequence
  source: /note="Description of Artificial Sequence: Synthetic oligonucleotide"
uggauuuaaucccaaaauuga

SEQ ID NO: 1611 - RNA, 21 nt, Artificial Sequence
  source: /note="Description of Artificial Sequence: Synthetic oligonucleotide"
gugaucuugcucaaugcagga

SEQ ID NO: 1612 - RNA, 21 nt, Artificial Sequence
  source: /note="Description of Artificial Sequence: Synthetic oligonucleotide"
guguuugguggauuuuacaua

SEQ ID NO: 1613 - RNA, 21 nt, Artificial Sequence
  source: /note="Description of Artificial Sequence: Synthetic oligonucleotide"
gaguuuccucaugaguuagga

SEQ ID NO: 1614 - RNA, 21 nt, Artificial Sequence
  source: /note="Description of Artificial Sequence: Synthetic oligonucleotide"
ucuggcagauauguuuccaga

SEQ ID NO: 1615 - RNA, 21 nt, Artificial Sequence
  source: /note="Description of Artificial Sequence: Synthetic oligonucleotide"
aagcaguugcuguguuuggua

SEQ ID NO: 1616 - RNA, 21 nt, Artificial Sequence
  source: /note="Description of Artificial Sequence: Synthetic oligonucleotide"
augagcauaauuauuuagcaa

SEQ ID NO: 1617 - RNA, 21 nt, Artificial Sequence
  source: /note="Description of Artificial Sequence: Synthetic oligonucleotide"
cucaucaccuuguacgcagga

SEQ ID NO: 1618 - RNA, 21 nt, Artificial Sequence
  source: /note="Description of Artificial Sequence: Synthetic oligonucleotide"
aaaguaacaugaauuaggaaa

SEQ ID NO: 1619 - RNA, 21 nt, Artificial Sequence
  source: /note="Description of Artificial Sequence: Synthetic oligonucleotide"
cgaccuguaggauuguuuuga

SEQ ID NO: 1620 - RNA, 21 nt, Artificial Sequence
  source: /note="Description of Artificial Sequence: Synthetic oligonucleotide"
agcaguugcuguguuugguga

SEQ ID NO: 1621 - RNA, 21 nt, Artificial Sequence
  source: /note="Description of Artificial Sequence: Synthetic oligonucleotide"
ccugcucaucaccuuguacga

SEQ ID NO: 1622 - RNA, 21 nt, Artificial Sequence
  source: /note="Description of Artificial Sequence: Synthetic oligonucleotide"
gcucaucaccuuguacgcaga

SEQ ID NO: 1623 - RNA, 21 nt, Artificial Sequence
  source: /note="Description of Artificial Sequence: Synthetic oligonucleotide"
gaacacuuaagaugcuacuga

SEQ ID NO: 1624 - RNA, 21 nt, Artificial Sequence
  source: /note="Description of Artificial Sequence: Synthetic oligonucleotide"
ggcgaccuguaggauuguuua

SEQ ID NO: 1625 - RNA, 21 nt, Artificial Sequence
  source: /note="Description of Artificial Sequence: Synthetic oligonucleotide"
ucuccugggauugauuuuaaa

SEQ ID NO: 1626 - RNA, 21 nt, Artificial Sequence
  source: /note="Description of Artificial Sequence: Synthetic oligonucleotide"
uguguuugguggauuuuacaa

SEQ ID NO: 1627 - RNA, 21 nt, Artificial Sequence
  source: /note="Description of Artificial Sequence: Synthetic oligonucleotide"
ggacacauccacuucgacaca

SEQ ID NO: 1628 - RNA, 21 nt, Artificial Sequence
  source: /note="Description of Artificial Sequence: Synthetic oligonucleotide"
cugcucaucaccuuguacgca

SEQ ID NO: 1629 - RNA, 21 nt, Artificial Sequence
  source: /note="Description of Artificial Sequence: Synthetic oligonucleotide"
agcuuucggcauuuuggugga

SEQ ID NO: 1630 - RNA, 21 nt, Artificial Sequence
  source: /note="Description of Artificial Sequence: Synthetic oligonucleotide"
uucucuggcagauauguuuca

SEQ ID NO: 1631 - RNA, 21 nt, Artificial Sequence
  source: /note="Description of Artificial Sequence: Synthetic oligonucleotide"
cccaaacugucagaaauagga

SEQ ID NO: 1632 - RNA, 21 nt, Artificial Sequence
  source: /note="Description of Artificial Sequence: Synthetic oligonucleotide"
aguaacuggaagacaaacgga

SEQ ID NO: 1633 - RNA, 21 nt, Artificial Sequence
  source: /note="Description of Artificial Sequence: Synthetic oligonucleotide"
ucucuccugggauugauuuua

SEQ ID NO: 1634 - RNA, 21 nt, Artificial Sequence
  source: /note="Description of Artificial Sequence: Synthetic oligonucleotide"
ucaccuucuucaugauccaga

SEQ ID NO: 1635 - RNA, 21 nt, Artificial Sequence
  source: /note="Description of Artificial Sequence: Synthetic oligonucleotide"
cucuggcagauauguuuccaa

SEQ ID NO: 1636 - RNA, 21 nt, Artificial Sequence
  source: /note="Description of Artificial Sequence: Synthetic oligonucleotide"
uagcuuucggcauuuugguga

SEQ ID NO: 1637 - RNA, 21 nt, Artificial Sequence
  source: /note="Description of Artificial Sequence: Synthetic oligonucleotide"
aaguaacuggaagacaaacga

SEQ ID NO: 1638 - RNA, 21 nt, Artificial Sequence
  source: /note="Description of Artificial Sequence: Synthetic oligonucleotide"
ucucuggcagauauguuucca

SEQ ID NO: 1639 - RNA, 21 nt, Artificial Sequence
  source: /note="Description of Artificial Sequence: Synthetic oligonucleotide"
ccagaggcauuuggauuuaaa

SEQ ID NO: 1640 - RNA, 21 nt, Artificial Sequence
  source: /note="Description of Artificial Sequence: Synthetic oligonucleotide"
ugugucagagacugaugguga

SEQ ID NO: 1641 - RNA, 21 nt, Artificial Sequence
  source: /note="Description of Artificial Sequence: Synthetic oligonucleotide"
cugugucagagacugauggua

SEQ ID NO: 1642 - RNA, 21 nt, Artificial Sequence
  source: /note="Description of Artificial Sequence: Synthetic oligonucleotide"
gaugagcauaauuauuuagca

SEQ ID NO: 1643 - RNA, 21 nt, Artificial Sequence
  source: /note="Description of Artificial Sequence: Synthetic oligonucleotide"
gugaggaguuuccucaugaga

SEQ ID NO: 1644 - RNA, 21 nt, Artificial Sequence
  source: /note="Description of Artificial Sequence: Synthetic oligonucleotide"
ggaguuuccucaugaguuaga

SEQ ID NO: 1645 - RNA, 23 nt, Artificial Sequence
  source: /note="Description of Artificial Sequence: Synthetic oligonucleotide"
ugagaaaccaugaagagaaaaga

SEQ ID NO: 1646 - RNA, 23 nt, Artificial Sequence
  source: /note="Description of Artificial Sequence: Synthetic oligonucleotide"
uaagagaaaagaugucuucugcu

SEQ ID NO: 1647 - RNA, 23 nt, Artificial Sequence
  source: /note="Description of Artificial Sequence: Synthetic oligonucleotide"
uacaacaaauuucaccuauucua

SEQ ID NO: 1648 - RNA, 23 nt, Artificial Sequence
  source: /note="Description of Artificial Sequence: Synthetic oligonucleotide"
uaaccaugaagagaaaagauguc

SEQ ID NO: 1649 - RNA, 23 nt, Artificial Sequence
  source: /note="Description of Artificial Sequence: Synthetic oligonucleotide"
ucguucaucucuggaaacauauc

SEQ ID NO: 1650 - RNA, 23 nt, Artificial Sequence
  source: /note="Description of Artificial Sequence: Synthetic oligonucleotide"
uccaugaagagaaaagaugucuu

SEQ ID NO: 1651 - RNA, 23 nt, Artificial Sequence
  source: /note="Description of Artificial Sequence: Synthetic oligonucleotide"
ucaugaagagaaaagaugucuuc

SEQ ID NO: 1652 - RNA, 23 nt, Artificial Sequence
  source: /note="Description of Artificial Sequence: Synthetic oligonucleotide"
uaacaacaaauuucaccuauucu

SEQ ID NO: 1653 - RNA, 23 nt, Artificial Sequence
  source: /note="Description of Artificial Sequence: Synthetic oligonucleotide"
uaaaccgaaaaccuuuuaaggaa

SEQ ID NO: 1654 - RNA, 23 nt, Artificial Sequence
  source: /note="Description of Artificial Sequence: Synthetic oligonucleotide"
ucauguaaaauccaccaaacaca

SEQ ID NO: 1655 - RNA, 23 nt, Artificial Sequence
  source: /note="Description of Artificial Sequence: Synthetic oligonucleotide"
ugaauaagcuggaaaauggcguu

SEQ ID NO: 1656 - RNA, 23 nt, Artificial Sequence
  source: /note="Description of Artificial Sequence: Synthetic oligonucleotide"
ugaaaccaugaagagaaaagaug

SEQ ID NO: 1657 - RNA, 23 nt, Artificial Sequence
  source: /note="Description of Artificial Sequence: Synthetic oligonucleotide"
uaccaugaagagaaaagaugucu

SEQ ID NO: 1658 - RNA, 23 nt, Artificial Sequence
  source: /note="Description of Artificial Sequence: Synthetic oligonucleotide"
uucccuauggagauguuucugug

SEQ ID NO: 1659 - RNA, 23 nt, Artificial Sequence
  source: /note="Description of Artificial Sequence: Synthetic oligonucleotide"
uuggaauaagcuggaaaauggcg

SEQ ID NO: 1660 - RNA, 23 nt, Artificial Sequence
  source: /note="Description of Artificial Sequence: Synthetic oligonucleotide"
uguaaaauccaccaaacacagca

SEQ ID NO: 1661 - RNA, 23 nt, Artificial Sequence
  source: /note="Description of Artificial Sequence: Synthetic oligonucleotide"
uuaacaacaaauuucaccuauuc

SEQ ID NO: 1662 - RNA, 23 nt, Artificial Sequence
  source: /note="Description of Artificial Sequence: Synthetic oligonucleotide"
uaugaagagaaaagaugucuucu

SEQ ID NO: 1663 - RNA, 23 nt, Artificial Sequence
  source: /note="Description of Artificial Sequence: Synthetic oligonucleotide"
uccaguuacuuuuucucucagca

SEQ ID NO: 1664 - RNA, 23 nt, Artificial Sequence
  source: /note="Description of Artificial Sequence: Synthetic oligonucleotide"
ugauuaaauccaaaugccucugg

SEQ ID NO: 1665 - RNA, 23 nt, Artificial Sequence
  source: /note="Description of Artificial Sequence: Synthetic oligonucleotide"
ucugaaaccagucauuagauucc

SEQ ID NO: 1666 - RNA, 23 nt, Artificial Sequence
  source: /note="Description of Artificial Sequence: Synthetic oligonucleotide"
uaacaaauuucaccuauucuaca

SEQ ID NO: 1667 - RNA, 23 nt, Artificial Sequence
  source: /note="Description of Artificial Sequence: Synthetic oligonucleotide"
ucaaagaaaagcauguaaaaucc

SEQ ID NO: 1668 - RNA, 23 nt, Artificial Sequence
  source: /note="Description of Artificial Sequence: Synthetic oligonucleotide"
ucuuucaaaacaauccuacaggu

SEQ ID NO: 1669 - RNA, 23 nt, Artificial Sequence
  source: /note="Description of Artificial Sequence: Synthetic oligonucleotide"
uuccguuugucuuccaguuacuu

SEQ ID NO: 1670 - RNA, 23 nt, Artificial Sequence
  source: /note="Description of Artificial Sequence: Synthetic oligonucleotide"
uugcguacaaggugaugagcagg

SEQ ID NO: 1671 - RNA, 23 nt, Artificial Sequence
  source: /note="Description of Artificial Sequence: Synthetic oligonucleotide"
ucugaagugaguauggucauucu

SEQ ID NO: 1672 - RNA, 23 nt, Artificial Sequence
  source: /note="Description of Artificial Sequence: Synthetic oligonucleotide"
uucaaaacaauccuacaggucgc

SEQ ID NO: 1673 - RNA, 23 nt, Artificial Sequence
  source: /note="Description of Artificial Sequence: Synthetic oligonucleotide"
ucaacaaauuucaccuauucuac

SEQ ID NO: 1674 - RNA, 23 nt, Artificial Sequence
  source: /note="Description of Artificial Sequence: Synthetic oligonucleotide"
uuaaaauccaccaaacacagcaa

SEQ ID NO: 1675 - RNA, 23 nt, Artificial Sequence
  source: /note="Description of Artificial Sequence: Synthetic oligonucleotide"
uguucgagcugguuaucugggug

SEQ ID NO: 1676 - RNA, 23 nt, Artificial Sequence
  source: /note="Description of Artificial Sequence: Synthetic oligonucleotide"
uaacaauccuacaggucgccaac

SEQ ID NO: 1677 - RNA, 23 nt, Artificial Sequence
  source: /note="Description of Artificial Sequence: Synthetic oligonucleotide"
uggauuaaauccaaaugccucug

SEQ ID NO: 1678 - RNA, 23 nt, Artificial Sequence
  source: /note="Description of Artificial Sequence: Synthetic oligonucleotide"
uaucauuccugaagugaguaugg

SEQ ID NO: 1679 - RNA, 23 nt, Artificial Sequence
  source: /note="Description of Artificial Sequence: Synthetic oligonucleotide"
ugguuaaaaucaaucccaggaga

SEQ ID NO: 1680 - RNA, 23 nt, Artificial Sequence
  source: /note="Description of Artificial Sequence: Synthetic oligonucleotide"
ucaucauuccugaagugaguaug

SEQ ID NO: 1681 - RNA, 23 nt, Artificial Sequence
  source: /note="Description of Artificial Sequence: Synthetic oligonucleotide"
uugucgaaguggauguguccguu

SEQ ID NO: 1682 - RNA, 23 nt, Artificial Sequence
  source: /note="Description of Artificial Sequence: Synthetic oligonucleotide"
ucaaauuucaccuauucuacaua

SEQ ID NO: 1683 - RNA, 23 nt, Artificial Sequence
  source: /note="Description of Artificial Sequence: Synthetic oligonucleotide"
ugucgaaguggauguguccguua

SEQ ID NO: 1684 - RNA, 23 nt, Artificial Sequence
  source: /note="Description of Artificial Sequence: Synthetic oligonucleotide"
ucugacagugucgaaguggaugu

SEQ ID NO: 1685 - RNA, 23 nt, Artificial Sequence
  source: /note="Description of Artificial Sequence: Synthetic oligonucleotide"
ucuggaauaagcuggaaaauggc

SEQ ID NO: 1686 - RNA, 23 nt, Artificial Sequence
  source: /note="Description of Artificial Sequence: Synthetic oligonucleotide"
uacucaugaggaaacuccucaca

SEQ ID NO: 1687 - RNA, 23 nt, Artificial Sequence
  source: /note="Description of Artificial Sequence: Synthetic oligonucleotide"
ucaguuacuuuuucucucagcau

SEQ ID NO: 1688 - RNA, 23 nt, Artificial Sequence
  source: /note="Description of Artificial Sequence: Synthetic oligonucleotide"
uuaaaaucaaucccaggagagag

SEQ ID NO: 1689 - RNA, 23 nt, Artificial Sequence
  source: /note="Description of Artificial Sequence: Synthetic oligonucleotide"
ucugaaaccgaaaaccuuuuaag

SEQ ID NO: 1690 - RNA, 23 nt, Artificial Sequence
  source: /note="Description of Artificial Sequence: Synthetic oligonucleotide"
ucugcauugagcaagaucacaaa

SEQ ID NO: 1691 - RNA, 23 nt, Artificial Sequence
  source: /note="Description of Artificial Sequence: Synthetic oligonucleotide"
uauuaaauccaaaugccucugga

SEQ ID NO: 1692 - RNA, 23 nt, Artificial Sequence
  source: /note="Description of Artificial Sequence: Synthetic oligonucleotide"
uacaaauuucaccuauucuacau

SEQ ID NO: 1693 - RNA, 23 nt, Artificial Sequence
  source: /note="Description of Artificial Sequence: Synthetic oligonucleotide"
uccugaagugaguauggucauuc

SEQ ID NO: 1694 - RNA, 23 nt, Artificial Sequence
  source: /note="Description of Artificial Sequence: Synthetic oligonucleotide"
uacuuuuucucucagcaugucgu

SEQ ID NO: 1695 - RNA, 23 nt, Artificial Sequence
  source: /note="Description of Artificial Sequence: Synthetic oligonucleotide"
uaaacauaucugccagagaaaug

SEQ ID NO: 1696 - RNA, 23 nt, Artificial Sequence
  source: /note="Description of Artificial Sequence: Synthetic oligonucleotide"
uguuaaaaucaaucccaggagag

SEQ ID NO: 1697 - RNA, 23 nt, Artificial Sequence
  source: /note="Description of Artificial Sequence: Synthetic oligonucleotide"
uuccaaaugccucuggaauaagc

SEQ ID NO: 1698 - RNA, 23 nt, Artificial Sequence
  source: /note="Description of Artificial Sequence: Synthetic oligonucleotide"
uuucaaaacaauccuacaggucg

SEQ ID NO: 1699 - RNA, 23 nt, Artificial Sequence
  source: /note="Description of Artificial Sequence: Synthetic oligonucleotide"
ucugcuaaauaauuaugcucauc

SEQ ID NO: 1700 - RNA, 23 nt, Artificial Sequence
  source: /note="Description of Artificial Sequence: Synthetic oligonucleotide"
ucaauuuugggauuaaauccaaa

SEQ ID NO: 1701 - RNA, 23 nt, Artificial Sequence
  source: /note="Description of Artificial Sequence: Synthetic oligonucleotide"
uccugcauugagcaagaucacaa

SEQ ID NO: 1702 - RNA, 23 nt, Artificial Sequence
  source: /note="Description of Artificial Sequence: Synthetic oligonucleotide"
uauguaaaauccaccaaacacag

SEQ ID NO: 1703 - RNA, 23 nt, Artificial Sequence
  source: /note="Description of Artificial Sequence: Synthetic oligonucleotide"
uccuaacucaugaggaaacuccu

SEQ ID NO: 1704 - RNA, 23 nt, Artificial Sequence
  source: /note="Description of Artificial Sequence: Synthetic oligonucleotide"
ucuggaaacauaucugccagaga

SEQ ID NO: 1705 - RNA, 23 nt, Artificial Sequence
  source: /note="Description of Artificial Sequence: Synthetic oligonucleotide"
uaccaaacacagcaacugcuuuc

SEQ ID NO: 1706 - RNA, 23 nt, Artificial Sequence
  source: /note="Description of Artificial Sequence: Synthetic oligonucleotide"
uugcuaaauaauuaugcucaucu

SEQ ID NO: 1707 - RNA, 23 nt, Artificial Sequence
  source: /note="Description of Artificial Sequence: Synthetic oligonucleotide"
uccugcguacaaggugaugagca

SEQ ID NO: 1708 - RNA, 23 nt, Artificial Sequence
  source: /note="Description of Artificial Sequence: Synthetic oligonucleotide"
uuuccuaauucauguuacuuugu

SEQ ID NO: 1709 - RNA, 23 nt, Artificial Sequence
  source: /note="Description of Artificial Sequence: Synthetic oligonucleotide"
ucaaaacaauccuacaggucgcc

SEQ ID NO: 1710 - RNA, 23 nt, Artificial Sequence
  source: /note="Description of Artificial Sequence: Synthetic oligonucleotide"
ucaccaaacacagcaacugcuuu

SEQ ID NO: 1711 - RNA, 23 nt, Artificial Sequence
  source: /note="Description of Artificial Sequence: Synthetic oligonucleotide"
ucguacaaggugaugagcaggau

SEQ ID NO: 1712 - RNA, 23 nt, Artificial Sequence
  source: /note="Description of Artificial Sequence: Synthetic oligonucleotide"
ucugcguacaaggugaugagcag

SEQ ID NO: 1713 - RNA, 23 nt, Artificial Sequence
  source: /note="Description of Artificial Sequence: Synthetic oligonucleotide"
ucaguagcaucuuaaguguucuc

SEQ ID NO: 1714 - RNA, 23 nt, Artificial Sequence
  source: /note="Description of Artificial Sequence: Synthetic oligonucleotide"
uaaacaauccuacaggucgccaa

SEQ ID NO: 1715 - RNA, 23 nt, Artificial Sequence
  source: /note="Description of Artificial Sequence: Synthetic oligonucleotide"
uuuaaaaucaaucccaggagaga

SEQ ID NO: 1716 - RNA, 23 nt, Artificial Sequence
  source: /note="Description of Artificial Sequence: Synthetic oligonucleotide"
uuguaaaauccaccaaacacagc

SEQ ID NO: 1717 - RNA, 23 nt, Artificial Sequence
  source: /note="Description of Artificial Sequence: Synthetic oligonucleotide"
ugugucgaaguggauguguccgu

SEQ ID NO: 1718 - RNA, 23 nt, Artificial Sequence
  source: /note="Description of Artificial Sequence: Synthetic oligonucleotide"
ugcguacaaggugaugagcagga

SEQ ID NO: 1719 - RNA, 23 nt, Artificial Sequence
  source: /note="Description of Artificial Sequence: Synthetic oligonucleotide"
uccaccaaaaugccgaaagcuag

SEQ ID NO: 1720 - RNA, 23 nt, Artificial Sequence
  source: /note="Description of Artificial Sequence: Synthetic oligonucleotide"
ugaaacauaucugccagagaaau

SEQ ID NO: 1721 - RNA, 23 nt, Artificial Sequence
  source: /note="Description of Artificial Sequence: Synthetic oligonucleotide"
uccuauuucugacaguuugggcc

SEQ ID NO: 1722 - RNA, 23 nt, Artificial Sequence
  source: /note="Description of Artificial Sequence: Synthetic oligonucleotide"
uccguuugucuuccaguuacuuu

SEQ ID NO: 1723 - RNA, 23 nt, Artificial Sequence
  source: /note="Description of Artificial Sequence: Synthetic oligonucleotide"
uaaaaucaaucccaggagagagg

SEQ ID NO: 1724 - RNA, 23 nt, Artificial Sequence
  source: /note="Description of Artificial Sequence: Synthetic oligonucleotide"
ucuggaucaugaagaaggugaaa

SEQ ID NO: 1725 - RNA, 23 nt, Artificial Sequence
  source: /note="Description of Artificial Sequence: Synthetic oligonucleotide"
uuggaaacauaucugccagagaa

SEQ ID NO: 1726 - RNA, 23 nt, Artificial Sequence
  source: /note="Description of Artificial Sequence: Synthetic oligonucleotide"
ucaccaaaaugccgaaagcuagu

SEQ ID NO: 1727 - RNA, 23 nt, Artificial Sequence
  source: /note="Description of Artificial Sequence: Synthetic oligonucleotide"
ucguuugucuuccaguuacuuuu

SEQ ID NO: 1728 - RNA, 23 nt, Artificial Sequence
  source: /note="Description of Artificial Sequence: Synthetic oligonucleotide"
uggaaacauaucugccagagaaa

SEQ ID NO: 1729 - RNA, 23 nt, Artificial Sequence
  source: /note="Description of Artificial Sequence: Synthetic oligonucleotide"
uuuaaauccaaaugccucuggaa

SEQ ID NO: 1730 - RNA, 23 nt, Artificial Sequence
  source: /note="Description of Artificial Sequence: Synthetic oligonucleotide"
ucaccaucagucucugacacagc

SEQ ID NO: 1731 - RNA, 23 nt, Artificial Sequence
  source: /note="Description of Artificial Sequence: Synthetic oligonucleotide"
uaccaucagucucugacacagcc

SEQ ID NO: 1732 - RNA, 23 nt, Artificial Sequence
  source: /note="Description of Artificial Sequence: Synthetic oligonucleotide"
ugcuaaauaauuaugcucaucuu

SEQ ID NO: 1733 - RNA, 23 nt, Artificial Sequence
  source: /note="Description of Artificial Sequence: Synthetic oligonucleotide"
ucucaugaggaaacuccucacac

SEQ ID NO: 1734 - RNA, 23 nt, Artificial Sequence
  source: /note="Description of Artificial Sequence: Synthetic oligonucleotide"
ucuaacucaugaggaaacuccuc

SEQ ID NO: 1735 - RNA, 23 nt, Artificial Sequence
  source: /note="Description of Artificial Sequence: Synthetic oligonucleotide"
ucuuuucucuucaugguuucuca

SEQ ID NO: 1736 - RNA, 23 nt, Artificial Sequence
  source: /note="Description of Artificial Sequence: Synthetic oligonucleotide"
agcagaagacaucuuuucucuuc

SEQ ID NO: 1737 - RNA, 23 nt, Artificial Sequence
  source: /note="Description of Artificial Sequence: Synthetic oligonucleotide"
uagaauaggugaaauuuguuguu

SEQ ID NO: 1738 - RNA, 23 nt, Artificial Sequence
  source: /note="Description of Artificial Sequence: Synthetic oligonucleotide"
gacaucuuuucucuucaugguuu

SEQ ID NO: 1739 - RNA, 23 nt, Artificial Sequence
  source: /note="Description of Artificial Sequence: Synthetic oligonucleotide"
gauauguuuccagagaugaacga

SEQ ID NO: 1740 - RNA, 23 nt, Artificial Sequence
  source: /note="Description of Artificial Sequence: Synthetic oligonucleotide"
aagacaucuuuucucuucauggu

SEQ ID NO: 1741 - RNA, 23 nt, Artificial Sequence
  source: /note="Description of Artificial Sequence: Synthetic oligonucleotide"
gaagacaucuuuucucuucaugg

SEQ ID NO: 1742 - RNA, 23 nt, Artificial Sequence
  source: /note="Description of Artificial Sequence: Synthetic oligonucleotide"
agaauaggugaaauuuguuguua

SEQ ID NO: 1743 - RNA, 23 nt, Artificial Sequence
  source: /note="Description of Artificial Sequence: Synthetic oligonucleotide"
uuccuuaaaagguuuucgguuuc

SEQ ID NO: 1744 - RNA, 23 nt, Artificial Sequence
  source: /note="Description of Artificial Sequence: Synthetic oligonucleotide"
uguguuugguggauuuuacaugc

SEQ ID NO: 1745 - RNA, 23 nt, Artificial Sequence
  source: /note="Description of Artificial Sequence: Synthetic oligonucleotide"
aacgccauuuuccagcuuauucc

SEQ ID NO: 1746 - RNA, 23 nt, Artificial Sequence
  source: /note="Description of Artificial Sequence: Synthetic oligonucleotide"
caucuuuucucuucaugguuucu

SEQ ID NO: 1747 - RNA, 23 nt, Artificial Sequence
  source: /note="Description of Artificial Sequence: Synthetic oligonucleotide"
agacaucuuuucucuucaugguu

SEQ ID NO: 1748 - RNA, 23 nt, Artificial Sequence
  source: /note="Description of Artificial Sequence: Synthetic oligonucleotide"
cacagaaacaucuccauagggau

SEQ ID NO: 1749 - RNA, 23 nt, Artificial Sequence
  source: /note="Description of Artificial Sequence: Synthetic oligonucleotide"
cgccauuuuccagcuuauuccag

SEQ ID NO: 1750 - RNA, 23 nt, Artificial Sequence
  source: /note="Description of Artificial Sequence: Synthetic oligonucleotide"
ugcuguguuugguggauuuuaca

SEQ ID NO: 1751 - RNA, 23 nt, Artificial Sequence
  source: /note="Description of Artificial Sequence: Synthetic oligonucleotide"
gaauaggugaaauuuguuguuaa

SEQ ID NO: 1752 - RNA, 23 nt, Artificial Sequence
  source: /note="Description of Artificial Sequence: Synthetic oligonucleotide"
agaagacaucuuuucucuucaug

SEQ ID NO: 1753 - RNA, 23 nt, Artificial Sequence
  source: /note="Description of Artificial Sequence: Synthetic oligonucleotide"
ugcugagagaaaaaguaacugga

SEQ ID NO: 1754 - RNA, 23 nt, Artificial Sequence
  source: /note="Description of Artificial Sequence: Synthetic oligonucleotide"
ccagaggcauuuggauuuaaucc

SEQ ID NO: 1755 - RNA, 23 nt, Artificial Sequence
  source: /note="Description of Artificial Sequence: Synthetic oligonucleotide"
ggaaucuaaugacugguuucaga

SEQ ID NO: 1756 - RNA, 23 nt, Artificial Sequence
  source: /note="Description of Artificial Sequence: Synthetic oligonucleotide"
uguagaauaggugaaauuuguug

SEQ ID NO: 1757 - RNA, 23 nt, Artificial Sequence
  source: /note="Description of Artificial Sequence: Synthetic oligonucleotide"
ggauuuuacaugcuuuucuuugu

SEQ ID NO: 1758 - RNA, 23 nt, Artificial Sequence
  source: /note="Description of Artificial Sequence: Synthetic oligonucleotide"
accuguaggauuguuuugaaagc

SEQ ID NO: 1759 - RNA, 23 nt, Artificial Sequence
  source: /note="Description of Artificial Sequence: Synthetic oligonucleotide"
aaguaacuggaagacaaacggau

SEQ ID NO: 1760 - RNA, 23 nt, Artificial Sequence
  source: /note="Description of Artificial Sequence: Synthetic oligonucleotide"
ccugcucaucaccuuguacgcag

SEQ ID NO: 1761 - RNA, 23 nt, Artificial Sequence
  source: /note="Description of Artificial Sequence: Synthetic oligonucleotide"
agaaugaccauacucacuucagg

SEQ ID NO: 1762 - RNA, 23 nt, Artificial Sequence
  source: /note="Description of Artificial Sequence: Synthetic oligonucleotide"
gcgaccuguaggauuguuuugaa

SEQ ID NO: 1763 - RNA, 23 nt, Artificial Sequence
  source: /note="Description of Artificial Sequence: Synthetic oligonucleotide"
guagaauaggugaaauuuguugu

SEQ ID NO: 1764 - RNA, 23 nt, Artificial Sequence
  source: /note="Description of Artificial Sequence: Synthetic oligonucleotide"
uugcuguguuugguggauuuuac

SEQ ID NO: 1765 - RNA, 23 nt, Artificial Sequence
  source: /note="Description of Artificial Sequence: Synthetic oligonucleotide"
cacccagauaaccagcucgaacu

SEQ ID NO: 1766 - RNA, 23 nt, Artificial Sequence
  source: /note="Description of Artificial Sequence: Synthetic oligonucleotide"
guuggcgaccuguaggauuguuu

SEQ ID NO: 1767 - RNA, 23 nt, Artificial Sequence
  source: /note="Description of Artificial Sequence: Synthetic oligonucleotide"
cagaggcauuuggauuuaauccc

SEQ ID NO: 1768 - RNA, 23 nt, Artificial Sequence
  source: /note="Description of Artificial Sequence: Synthetic oligonucleotide"
ccauacucacuucaggaaugaug

SEQ ID NO: 1769 - RNA, 23 nt, Artificial Sequence
  source: /note="Description of Artificial Sequence: Synthetic oligonucleotide"
ucuccugggauugauuuuaaccc

SEQ ID NO: 1770 - RNA, 23 nt, Artificial Sequence
  source: /note="Description of Artificial Sequence: Synthetic oligonucleotide"
cauacucacuucaggaaugauga

SEQ ID NO: 1771 - RNA, 23 nt, Artificial Sequence
  source: /note="Description of Artificial Sequence: Synthetic oligonucleotide"
aacggacacauccacuucgacac

SEQ ID NO: 1772 - RNA, 23 nt, Artificial Sequence
  source: /note="Description of Artificial Sequence: Synthetic oligonucleotide"
uauguagaauaggugaaauuugu

SEQ ID NO: 1773 - RNA, 23 nt, Artificial Sequence
  source: /note="Description of Artificial Sequence: Synthetic oligonucleotide"
uaacggacacauccacuucgaca

SEQ ID NO: 1774 - RNA, 23 nt, Artificial Sequence
  source: /note="Description of Artificial Sequence: Synthetic oligonucleotide"
acauccacuucgacacugucagc

SEQ ID NO: 1775 - RNA, 23 nt, Artificial Sequence
  source: /note="Description of Artificial Sequence: Synthetic oligonucleotide"
gccauuuuccagcuuauuccaga

SEQ ID NO: 1776 - RNA, 23 nt, Artificial Sequence
  source: /note="Description of Artificial Sequence: Synthetic oligonucleotide"
ugugaggaguuuccucaugaguu

SEQ ID NO: 1777 - RNA, 23 nt, Artificial Sequence
  source: /note="Description of Artificial Sequence: Synthetic oligonucleotide"
augcugagagaaaaaguaacugg

SEQ ID NO: 1778 - RNA, 23 nt, Artificial Sequence
  source: /note="Description of Artificial Sequence: Synthetic oligonucleotide"
cucucuccugggauugauuuuaa

SEQ ID NO: 1779 - RNA, 23 nt, Artificial Sequence
  source: /note="Description of Artificial Sequence: Synthetic oligonucleotide"
cuuaaaagguuuucgguuucaga

SEQ ID NO: 1780 - RNA, 23 nt, Artificial Sequence
  source: /note="Description of Artificial Sequence: Synthetic oligonucleotide"
uuugugaucuugcucaaugcagg

SEQ ID NO: 1781 - RNA, 23 nt, Artificial Sequence
  source: /note="Description of Artificial Sequence: Synthetic oligonucleotide"
uccagaggcauuuggauuuaauc

SEQ ID NO: 1782 - RNA, 23 nt, Artificial Sequence
  source: /note="Description of Artificial Sequence: Synthetic oligonucleotide"
auguagaauaggugaaauuuguu

SEQ ID NO: 1783 - RNA, 23 nt, Artificial Sequence
  source: /note="Description of Artificial Sequence: Synthetic oligonucleotide"
gaaugaccauacucacuucagga

SEQ ID NO: 1784 - RNA, 23 nt, Artificial Sequence
  source: /note="Description of Artificial Sequence: Synthetic oligonucleotide"
acgacaugcugagagaaaaagua

SEQ ID NO: 1785 - RNA, 23 nt, Artificial Sequence
  source: /note="Description of Artificial Sequence: Synthetic oligonucleotide"
cauuucucuggcagauauguuuc

SEQ ID NO: 1786 - RNA, 23 nt, Artificial Sequence
  source: /note="Description of Artificial Sequence: Synthetic oligonucleotide"
cucuccugggauugauuuuaacc

SEQ ID NO: 1787 - RNA, 23 nt, Artificial Sequence
  source: /note="Description of Artificial Sequence: Synthetic oligonucleotide"
gcuuauuccagaggcauuuggau

SEQ ID NO: 1788 - RNA, 23 nt, Artificial Sequence
  source: /note="Description of Artificial Sequence: Synthetic oligonucleotide"
cgaccuguaggauuguuuugaaa

SEQ ID NO: 1789 - RNA, 23 nt, Artificial Sequence
  source: /note="Description of Artificial Sequence: Synthetic oligonucleotide"
gaugagcauaauuauuuagcagg

SEQ ID NO: 1790 - RNA, 23 nt, Artificial Sequence
  source: /note="Description of Artificial Sequence: Synthetic oligonucleotide"
uuuggauuuaaucccaaaauuga

SEQ ID NO: 1791 - RNA, 23 nt, Artificial Sequence
  source: /note="Description of Artificial Sequence: Synthetic oligonucleotide"
uugugaucuugcucaaugcagga

SEQ ID NO: 1792 - RNA, 23 nt, Artificial Sequence
  source: /note="Description of Artificial Sequence: Synthetic oligonucleotide"
cuguguuugguggauuuuacaug

SEQ ID NO: 1793 - RNA, 23 nt, Artificial Sequence
  source: /note="Description of Artificial Sequence: Synthetic oligonucleotide"
aggaguuuccucaugaguuaggg

SEQ ID NO: 1794 - RNA, 23 nt, Artificial Sequence
  source: /note="Description of Artificial Sequence: Synthetic oligonucleotide"
ucucuggcagauauguuuccaga

SEQ ID NO: 1795 - RNA, 23 nt, Artificial Sequence
  source: /note="Description of Artificial Sequence: Synthetic oligonucleotide"
gaaagcaguugcuguguuuggug

SEQ ID NO: 1796 - RNA, 23 nt, Artificial Sequence
  source: /note="Description of Artificial Sequence: Synthetic oligonucleotide"
agaugagcauaauuauuuagcag

SEQ ID NO: 1797 - RNA, 23 nt, Artificial Sequence
  source: /note="Description of Artificial Sequence: Synthetic oligonucleotide"
ugcucaucaccuuguacgcagga

SEQ ID NO: 1798 - RNA, 23 nt, Artificial Sequence
  source: /note="Description of Artificial Sequence: Synthetic oligonucleotide"
acaaaguaacaugaauuaggaaa

SEQ ID NO: 1799 - RNA, 23 nt, Artificial Sequence
  source: /note="Description of Artificial Sequence: Synthetic oligonucleotide"
ggcgaccuguaggauuguuuuga

SEQ ID NO: 1800 - RNA, 23 nt, Artificial Sequence
  source: /note="Description of Artificial Sequence: Synthetic oligonucleotide"
aaagcaguugcuguguuuggugg

SEQ ID NO: 1801 - RNA, 23 nt, Artificial Sequence
  source: /note="Description of Artificial Sequence: Synthetic oligonucleotide"
auccugcucaucaccuuguacgc

SEQ ID NO: 1802 - RNA, 23 nt, Artificial Sequence
  source: /note="Description of Artificial Sequence: Synthetic oligonucleotide"
cugcucaucaccuuguacgcagg

SEQ ID NO: 1803 - RNA, 23 nt, Artificial Sequence
  source: /note="Description of Artificial Sequence: Synthetic oligonucleotide"
gagaacacuuaagaugcuacuga

SEQ ID NO: 1804 - RNA, 23 nt, Artificial Sequence
  source: /note="Description of Artificial Sequence: Synthetic oligonucleotide"
uuggcgaccuguaggauuguuuu

SEQ ID NO: 1805 - RNA, 23 nt, Artificial Sequence
  source: /note="Description of Artificial Sequence: Synthetic oligonucleotide"
ucucuccugggauugauuuuaac

SEQ ID NO: 1806 - RNA, 23 nt, Artificial Sequence
  source: /note="Description of Artificial Sequence: Synthetic oligonucleotide"
gcuguguuugguggauuuuacau

SEQ ID NO: 1807 - RNA, 23 nt, Artificial Sequence
  source: /note="Description of Artificial Sequence: Synthetic oligonucleotide"
acggacacauccacuucgacacu

SEQ ID NO: 1808 - RNA, 23 nt, Artificial Sequence
  source: /note="Description of Artificial Sequence: Synthetic oligonucleotide"
uccugcucaucaccuuguacgca

SEQ ID NO: 1809 - RNA, 23 nt, Artificial Sequence
  source: /note="Description of Artificial Sequence: Synthetic oligonucleotide"
cuagcuuucggcauuuugguggg

SEQ ID NO: 1810 - RNA, 23 nt, Artificial Sequence
  source: /note="Description of Artificial Sequence: Synthetic oligonucleotide"
auuucucuggcagauauguuucc

SEQ ID NO: 1811 - RNA, 23 nt, Artificial Sequence
  source: /note="Description of Artificial Sequence: Synthetic oligonucleotide"
ggcccaaacugucagaaauagga

SEQ ID NO: 1812 - RNA, 23 nt, Artificial Sequence
  source: /note="Description of Artificial Sequence: Synthetic oligonucleotide"
aaaguaacuggaagacaaacgga

SEQ ID NO: 1813 - RNA, 23 nt, Artificial Sequence
  source: /note="Description of Artificial Sequence: Synthetic oligonucleotide"
ccucucuccugggauugauuuua

SEQ ID NO: 1814 - RNA, 23 nt, Artificial Sequence
  source: /note="Description of Artificial Sequence: Synthetic oligonucleotide"
uuucaccuucuucaugauccaga

SEQ ID NO: 1815 - RNA, 23 nt, Artificial Sequence
  source: /note="Description of Artificial Sequence: Synthetic oligonucleotide"
uucucuggcagauauguuuccag

SEQ ID NO: 1816 - RNA, 23 nt, Artificial Sequence
  source: /note="Description of Artificial Sequence: Synthetic oligonucleotide"
acuagcuuucggcauuuuggugg

SEQ ID NO: 1817 - RNA, 23 nt, Artificial Sequence
  source: /note="Description of Artificial Sequence: Synthetic oligonucleotide"
aaaaguaacuggaagacaaacgg

SEQ ID NO: 1818 - RNA, 23 nt, Artificial Sequence
  source: /note="Description of Artificial Sequence: Synthetic oligonucleotide"
uuucucuggcagauauguuucca

SEQ ID NO: 1819 - RNA, 23 nt, Artificial Sequence
  source: /note="Description of Artificial Sequence: Synthetic oligonucleotide"
uuccagaggcauuuggauuuaau

SEQ ID NO: 1820 - RNA, 23 nt, Artificial Sequence
  source: /note="Description of Artificial Sequence: Synthetic oligonucleotide"
gcugugucagagacugauggugg

SEQ ID NO: 1821 - RNA, 23 nt, Artificial Sequence
  source: /note="Description of Artificial Sequence: Synthetic oligonucleotide"
ggcugugucagagacugauggug

SEQ ID NO: 1822 - RNA, 23 nt, Artificial Sequence
  source: /note="Description of Artificial Sequence: Synthetic oligonucleotide"
aagaugagcauaauuauuuagca

SEQ ID NO: 1823 - RNA, 23 nt, Artificial Sequence
  source: /note="Description of Artificial Sequence: Synthetic oligonucleotide"
gugugaggaguuuccucaugagu

SEQ ID NO: 1824 - RNA, 23 nt, Artificial Sequence
  source: /note="Description of Artificial Sequence: Synthetic oligonucleotide"
gaggaguuuccucaugaguuagg

SEQ ID NO: 1825 - RNA, 21 nt, Artificial Sequence
  source: /note="Description of Artificial Sequence: Synthetic oligonucleotide"
cuguguuugguggauuuuaca

SEQ ID NO: 1826 - RNA, 21 nt, Artificial Sequence
  source: /note="Description of Artificial Sequence: Synthetic oligonucleotide"
guugcuguguuugguggauua

SEQ ID NO: 1827 - RNA, 21 nt, Artificial Sequence
  source: /note="Description of Artificial Sequence: Synthetic oligonucleotide"
caguugcuguguuugguggaa

SEQ ID NO: 1828 - RNA, 21 nt, Artificial Sequence
  source: /note="Description of Artificial Sequence: Synthetic oligonucleotide"
gcuguguuugguggauuuuaa

SEQ ID NO: 1829 - RNA, 21 nt, Artificial Sequence
  source: /note="Description of Artificial Sequence: Synthetic oligonucleotide"
uuauuccagaggcauuuggaa

SEQ ID NO: 1830 - RNA, 21 nt, Artificial Sequence
  source: /note="Description of Artificial Sequence: Synthetic oligonucleotide"
aguugcuguguuugguggaua

SEQ ID NO: 1831 - RNA, 21 nt, Artificial Sequence
  source: /note="Description of Artificial Sequence: Synthetic oligonucleotide"
auuccagaggcauuuggauua

SEQ ID NO: 1832 - RNA, 21 nt, Artificial Sequence
  source: /note="Description of Artificial Sequence: Synthetic oligonucleotide"
cucuggcagauauguuuccaa

SEQ ID NO: 1833 - RNA, 21 nt, Artificial Sequence
  source: /note="Description of Artificial Sequence: Synthetic oligonucleotide"
ggcaguugcuguguuugguga

SEQ ID NO: 1834 - RNA, 21 nt, Artificial Sequence
  source: /note="Description of Artificial Sequence: Synthetic oligonucleotide"
aggcaguugcuguguuuggua

SEQ ID NO: 1835 - RNA, 21 nt, Artificial Sequence
  source: /note="Description of Artificial Sequence: Synthetic oligonucleotide"
ucuggcagauauguuuccaga

SEQ ID NO: 1836 - RNA, 21 nt, Artificial Sequence
  source: /note="Description of Artificial Sequence: Synthetic oligonucleotide"
cuuauuccagaggcauuugga

SEQ ID NO: 1837 - RNA, 21 nt, Artificial Sequence
  source: /note="Description of Artificial Sequence: Synthetic oligonucleotide"
cccaaacugucagaaauagga

SEQ ID NO: 1838 - RNA, 21 nt, Artificial Sequence
  source: /note="Description of Artificial Sequence: Synthetic oligonucleotide"
uucucuggcagauauguuuca

SEQ ID NO: 1839 - RNA, 21 nt, Artificial Sequence
  source: /note="Description of Artificial Sequence: Synthetic oligonucleotide"
acuuauuccagaggcauuuga

SEQ ID NO: 1840 - RNA, 21 nt, Artificial Sequence
  source: /note="Description of Artificial Sequence: Synthetic oligonucleotide"
ucucuggcagauauguuucca

SEQ ID NO: 1841 - RNA, 21 nt, Artificial Sequence
  source: /note="Description of Artificial Sequence: Synthetic oligonucleotide"
gcccaaacugucagaaauaga

SEQ ID NO: 1842 - RNA, 21 nt, Artificial Sequence
  source: /note="Description of Artificial Sequence: Synthetic oligonucleotide"
gcaguugcuguguuuggugga

SEQ ID NO: 1843 - RNA, 21 nt, Artificial Sequence
  source: /note="Description of Artificial Sequence: Synthetic oligonucleotide"
auuucucuggcagauauguua

SEQ ID NO: 1844 - RNA, 21 nt, Artificial Sequence
  source: /note="Description of Artificial Sequence: Synthetic oligonucleotide"
uauuucucuggcagauaugua

SEQ ID NO: 1845 - RNA, 21 nt, Artificial Sequence
  source: /note="Description of Artificial Sequence: Synthetic oligonucleotide"
uuucucuggcagauauguuua

SEQ ID NO: 1846 - RNA, 21 nt, Artificial Sequence
  source: /note="Description of Artificial Sequence: Synthetic oligonucleotide"
auauuucucuggcagauauga

SEQ ID NO: 1847 - RNA, 23 nt, Artificial Sequence
  source: /note="Description of Artificial Sequence: Synthetic oligonucleotide"
uguaaaauccaccaaacacagca

SEQ ID NO: 1848 - RNA, 23 nt, Artificial Sequence
  source: /note="Description of Artificial Sequence: Synthetic oligonucleotide"
uaauccaccaaacacagcaacug

SEQ ID NO: 1849 - RNA, 23 nt, Artificial Sequence
  source: /note="Description of Artificial Sequence: Synthetic oligonucleotide"
uuccaccaaacacagcaacugcc

SEQ ID NO: 1850 - RNA, 23 nt, Artificial Sequence
  source: /note="Description of Artificial Sequence: Synthetic oligonucleotide"
uuaaaauccaccaaacacagcaa

SEQ ID NO: 1851 - RNA, 23 nt, Artificial Sequence
  source: /note="Description of Artificial Sequence: Synthetic oligonucleotide"
uuccaaaugccucuggaauaagu

SEQ ID NO: 1852 - RNA, 23 nt, Artificial Sequence
  source: /note="Description of Artificial Sequence: Synthetic oligonucleotide"
uauccaccaaacacagcaacugc

SEQ ID NO: 1853 - RNA, 23 nt, Artificial Sequence
  source: /note="Description of Artificial Sequence: Synthetic oligonucleotide"
uaauccaaaugccucuggaauaa

SEQ ID NO: 1854 - RNA, 23 nt, Artificial Sequence
  source: /note="Description of Artificial Sequence: Synthetic oligonucleotide"
uuggaaacauaucugccagagaa

SEQ ID NO: 1855 - RNA, 23 nt, Artificial Sequence
  source: /note="Description of Artificial Sequence: Synthetic oligonucleotide"
ucaccaaacacagcaacugccuu

SEQ ID NO: 1856 - RNA, 23 nt, Artificial Sequence
  source: /note="Description of Artificial Sequence: Synthetic oligonucleotide"
uaccaaacacagcaacugccuuc

SEQ ID NO: 1857 - RNA, 23 nt, Artificial Sequence
  source: /note="Description of Artificial Sequence: Synthetic oligonucleotide"
ucuggaaacauaucugccagaga

SEQ ID NO: 1858 - RNA, 23 nt, Artificial Sequence
  source: /note="Description of Artificial Sequence: Synthetic oligonucleotide"
uccaaaugccucuggaauaaguu

SEQ ID NO: 1859 - RNA, 23 nt, Artificial Sequence
  source: /note="Description of Artificial Sequence: Synthetic oligonucleotide"
uccuauuucugacaguuugggcc

SEQ ID NO: 1860 - RNA, 23 nt, Artificial Sequence
  source: /note="Description of Artificial Sequence: Synthetic oligonucleotide"
ugaaacauaucugccagagaaau

SEQ ID NO: 1861 - RNA, 23 nt, Artificial Sequence
  source: /note="Description of Artificial Sequence: Synthetic oligonucleotide"
ucaaaugccucuggaauaaguug

SEQ ID NO: 1862 - RNA, 23 nt, Artificial Sequence
  source: /note="Description of Artificial Sequence: Synthetic oligonucleotide"
uggaaacauaucugccagagaaa

SEQ ID NO: 1863 - RNA, 23 nt, Artificial Sequence
  source: /note="Description of Artificial Sequence: Synthetic oligonucleotide"
ucuauuucugacaguuugggccc

SEQ ID NO: 1864 - RNA, 23 nt, Artificial Sequence
  source: /note="Description of Artificial Sequence: Synthetic oligonucleotide"
uccaccaaacacagcaacugccu

SEQ ID NO: 1865 - RNA, 23 nt, Artificial Sequence
  source: /note="Description of Artificial Sequence: Synthetic oligonucleotide"
uaacauaucugccagagaaauau

SEQ ID NO: 1866 - RNA, 23 nt, Artificial Sequence
  source: /note="Description of Artificial Sequence: Synthetic oligonucleotide"
uacauaucugccagagaaauaua

SEQ ID NO: 1867 - RNA, 23 nt, Artificial Sequence
  source: /note="Description of Artificial Sequence: Synthetic oligonucleotide"
uaaacauaucugccagagaaaua

SEQ ID NO: 1868 - RNA, 23 nt, Artificial Sequence
  source: /note="Description of Artificial Sequence: Synthetic oligonucleotide"
ucauaucugccagagaaauauag

SEQ ID NO: 1869 - RNA, 21 nt, Artificial Sequence
  source: /note="Description of Artificial Sequence: Synthetic oligonucleotide"
cuguguuugguggauuuuaca

SEQ ID NO: 1870 - RNA, 21 nt, Artificial Sequence
  source: /note="Description of Artificial Sequence: Synthetic oligonucleotide"
guugcuguguuugguggauua

SEQ ID NO: 1871 - RNA, 21 nt, Artificial Sequence
  source: /note="Description of Artificial Sequence: Synthetic oligonucleotide"
caguugcuguguuugguggaa

SEQ ID NO: 1872 - RNA, 21 nt, Artificial Sequence
  source: /note="Description of Artificial Sequence: Synthetic oligonucleotide"
gcuguguuugguggauuuuaa

SEQ ID NO: 1873 - RNA, 21 nt, Artificial Sequence
  source: /note="Description of Artificial Sequence: Synthetic oligonucleotide"
uuauuccagaggcauuuggaa

SEQ ID NO: 1874 - RNA, 21 nt, Artificial Sequence
  source: /note="Description of Artificial Sequence: Synthetic oligonucleotide"
aguugcuguguuugguggaua

SEQ ID NO: 1875 - RNA, 21 nt, Artificial Sequence
  source: /note="Description of Artificial Sequence: Synthetic oligonucleotide"
auuccagaggcauuuggauua

SEQ ID NO: 1876 - RNA, 21 nt, Artificial Sequence
  source: /note="Description of Artificial Sequence: Synthetic oligonucleotide"
cucuggcagauauguuuccaa

SEQ ID NO: 1877 - RNA, 21 nt, Artificial Sequence
  source: /note="Description of Artificial Sequence: Synthetic oligonucleotide"
ggcaguugcuguguuugguga

SEQ ID NO: 1878 - RNA, 21 nt, Artificial Sequence
  source: /note="Description of Artificial Sequence: Synthetic oligonucleotide"
aggcaguugcuguguuuggua

SEQ ID NO: 1879 - RNA, 21 nt, Artificial Sequence
  source: /note="Description of Artificial Sequence: Synthetic oligonucleotide"
ucuggcagauauguuuccaga

SEQ ID NO: 1880 - RNA, 21 nt, Artificial Sequence
  source: /note="Description of Artificial Sequence: Synthetic oligonucleotide"
cuuauuccagaggcauuugga

SEQ ID NO: 1881 - RNA, 21 nt, Artificial Sequence
  source: /note="Description of Artificial Sequence: Synthetic oligonucleotide"
cccaaacugucagaaauagga

SEQ ID NO: 1882 - RNA, 21 nt, Artificial Sequence
  source: /note="Description of Artificial Sequence: Synthetic oligonucleotide"
uucucuggcagauauguuuca

SEQ ID NO: 1883 - RNA, 21 nt, Artificial Sequence
  source: /note="Description of Artificial Sequence: Synthetic oligonucleotide"
acuuauuccagaggcauuuga

SEQ ID NO: 1884 - RNA, 21 nt, Artificial Sequence
  source: /note="Description of Artificial Sequence: Synthetic oligonucleotide"
ucucuggcagauauguuucca

SEQ ID NO: 1885 - RNA, 21 nt, Artificial Sequence
  source: /note="Description of Artificial Sequence: Synthetic oligonucleotide"
gcccaaacugucagaaauaga

SEQ ID NO: 1886 - RNA, 21 nt, Artificial Sequence
  source: /note="Description of Artificial Sequence: Synthetic oligonucleotide"
gcaguugcuguguuuggugga

SEQ ID NO: 1887 - RNA, 21 nt, Artificial Sequence
  source: /note="Description of Artificial Sequence: Synthetic oligonucleotide"
auuucucuggcagauauguua

SEQ ID NO: 1888 - RNA, 21 nt, Artificial Sequence
  source: /note="Description of Artificial Sequence: Synthetic oligonucleotide"
uauuucucuggcagauaugua

SEQ ID NO: 1889 - RNA, 21 nt, Artificial Sequence
  source: /note="Description of Artificial Sequence: Synthetic oligonucleotide"
uuucucuggcagauauguuua

SEQ ID NO: 1890 - RNA, 21 nt, Artificial Sequence
  source: /note="Description of Artificial Sequence: Synthetic oligonucleotide"
auauuucucuggcagauauga

SEQ ID NO: 1891 - RNA, 23 nt, Artificial Sequence
  source: /note="Description of Artificial Sequence: Synthetic oligonucleotide"
uguaaaauccaccaaacacagca

SEQ ID NO: 1892 - RNA, 23 nt, Artificial Sequence
  source: /note="Description of Artificial Sequence: Synthetic oligonucleotide"
uaauccaccaaacacagcaacug

SEQ ID NO: 1893 - RNA, 23 nt, Artificial Sequence
  source: /note="Description of Artificial Sequence: Synthetic oligonucleotide"
uuccaccaaacacagcaacugcc

SEQ ID NO: 1894 - RNA, 23 nt, Artificial Sequence
  source: /note="Description of Artificial Sequence: Synthetic oligonucleotide"
uuaaaauccaccaaacacagcaa

SEQ ID NO: 1895 - RNA, 23 nt, Artificial Sequence
  source: /note="Description of Artificial Sequence: Synthetic oligonucleotide"
uuccaaaugccucuggaauaagu

SEQ ID NO: 1896 - RNA, 23 nt, Artificial Sequence
  source: /note="Description of Artificial Sequence: Synthetic oligonucleotide"
uauccaccaaacacagcaacugc

SEQ ID NO: 1897 - RNA, 23 nt, Artificial Sequence
  source: /note="Description of Artificial Sequence: Synthetic oligonucleotide"
uaauccaaaugccucuggaauaa

SEQ ID NO: 1898 - RNA, 23 nt, Artificial Sequence
  source: /note="Description of Artificial Sequence: Synthetic oligonucleotide"
uuggaaacauaucugccagagaa

SEQ ID NO: 1899 - RNA, 23 nt, Artificial Sequence
  source: /note="Description of Artificial Sequence: Synthetic oligonucleotide"
ucaccaaacacagcaacugccuu

SEQ ID NO: 1900 - RNA, 23 nt, Artificial Sequence
  source: /note="Description of Artificial Sequence: Synthetic oligonucleotide"
uaccaaacacagcaacugccuuc

SEQ ID NO: 1901 - RNA, 23 nt, Artificial Sequence
  source: /note="Description of Artificial Sequence: Synthetic oligonucleotide"
ucuggaaacauaucugccagaga

SEQ ID NO: 1902 - RNA, 23 nt, Artificial Sequence
  source: /note="Description of Artificial Sequence: Synthetic oligonucleotide"
uccaaaugccucuggaauaaguu

SEQ ID NO: 1903 - RNA, 23 nt, Artificial Sequence
  source: /note="Description of Artificial Sequence: Synthetic oligonucleotide"
uccuauuucugacaguuugggcc

SEQ ID NO: 1904 - RNA, 23 nt, Artificial Sequence
  source: /note="Description of Artificial Sequence: Synthetic oligonucleotide"
ugaaacauaucugccagagaaau

SEQ ID NO: 1905 - RNA, 23 nt, Artificial Sequence
  source: /note="Description of Artificial Sequence: Synthetic oligonucleotide"
ucaaaugccucuggaauaaguug

SEQ ID NO: 1906 - RNA, 23 nt, Artificial Sequence
  source: /note="Description of Artificial Sequence: Synthetic oligonucleotide"
uggaaacauaucugccagagaaa

SEQ ID NO: 1907 - RNA, 23 nt, Artificial Sequence
  source: /note="Description of Artificial Sequence: Synthetic oligonucleotide"
ucuauuucugacaguuugggccc

SEQ ID NO: 1908 - RNA, 23 nt, Artificial Sequence
  source: /note="Description of Artificial Sequence: Synthetic oligonucleotide"
uccaccaaacacagcaacugccu

SEQ ID NO: 1909 - RNA, 23 nt, Artificial Sequence
  source: /note="Description of Artificial Sequence: Synthetic oligonucleotide"
uaacauaucugccagagaaauau

SEQ ID NO: 1910 - RNA, 23 nt, Artificial Sequence
  source: /note="Description of Artificial Sequence: Synthetic oligonucleotide"
uacauaucugccagagaaauaua

SEQ ID NO: 1911 - RNA, 23 nt, Artificial Sequence
  source: /note="Description of Artificial Sequence: Synthetic oligonucleotide"
uaaacauaucugccagagaaaua

SEQ ID NO: 1912 - RNA, 23 nt, Artificial Sequence
  source: /note="Description of Artificial Sequence: Synthetic oligonucleotide"
ucauaucugccagagaaauauag

SEQ ID NO: 1913 - RNA, 23 nt, Artificial Sequence
  source: /note="Description of Artificial Sequence: Synthetic oligonucleotide"
ugcuguguuugguggauuuuaca

SEQ ID NO: 1914 - RNA, 23 nt, Artificial Sequence
  source: /note="Description of Artificial Sequence: Synthetic oligonucleotide"
caguugcuguguuugguggauuu

SEQ ID NO: 1915 - RNA, 23 nt, Artificial Sequence
  source: /note="Description of Artificial Sequence: Synthetic oligonucleotide"
agcaguugcuguguuugguggau

SEQ ID NO: 1916 - RNA, 23 nt, Artificial Sequence
  source: /note="Description of Artificial Sequence: Synthetic oligonucleotide"
uugcuguguuugguggauuuuac

SEQ ID NO: 1917 - RNA, 23 nt, Artificial Sequence
  source: /note="Description of Artificial Sequence: Synthetic oligonucleotide"
gcuuauuccagaggcauuuggau

SEQ ID NO: 1918 - RNA, 23 nt, Artificial Sequence
  source: /note="Description of Artificial Sequence: Synthetic oligonucleotide"
gcaguugcuguguuugguggauu

SEQ ID NO: 1919 - RNA, 23 nt, Artificial Sequence
  source: /note="Description of Artificial Sequence: Synthetic oligonucleotide"
uuauuccagaggcauuuggauuu

SEQ ID NO: 1920 - RNA, 23 nt, Artificial Sequence
  source: /note="Description of Artificial Sequence: Synthetic oligonucleotide"
uucucuggcagauauguuuccag

SEQ ID NO: 1921 - RNA, 23 nt, Artificial Sequence
  source: /note="Description of Artificial Sequence: Synthetic oligonucleotide"
aaggcaguugcuguguuuggugg

SEQ ID NO: 1922 - RNA, 23 nt, Artificial Sequence
  source: /note="Description of Artificial Sequence: Synthetic oligonucleotide"
gaaggcaguugcuguguuuggug

SEQ ID NO: 1923 - RNA, 23 nt, Artificial Sequence
  source: /note="Description of Artificial Sequence: Synthetic oligonucleotide"
ucucuggcagauauguuuccaga

SEQ ID NO: 1924 - RNA, 23 nt, Artificial Sequence
  source: /note="Description of Artificial Sequence: Synthetic oligonucleotide"
cuuauuccagaggcauuuggauu

SEQ ID NO: 1925 - RNA, 23 nt, Artificial Sequence
  source: /note="Description of Artificial Sequence: Synthetic oligonucleotide"
ggcccaaacugucagaaauagga

SEQ ID NO: 1926 - RNA, 23 nt, Artificial Sequence
  source: /note="Description of Artificial Sequence: Synthetic oligonucleotide"
auuucucuggcagauauguuucc

SEQ ID NO: 1927 - RNA, 23 nt, Artificial Sequence
  source: /note="Description of Artificial Sequence: Synthetic oligonucleotide"
caacuuauuccagaggcauuugg

SEQ ID NO: 1928 - RNA, 23 nt, Artificial Sequence
  source: /note="Description of Artificial Sequence: Synthetic oligonucleotide"
uuucucuggcagauauguuucca

SEQ ID NO: 1929 - RNA, 23 nt, Artificial Sequence
  source: /note="Description of Artificial Sequence: Synthetic oligonucleotide"
gggcccaaacugucagaaauagg

SEQ ID NO: 1930 - RNA, 23 nt, Artificial Sequence
  source: /note="Description of Artificial Sequence: Synthetic oligonucleotide"
aagcaguugcuguguuuggugga

SEQ ID NO: 1931 - RNA, 23 nt, Artificial Sequence
  source: /note="Description of Artificial Sequence: Synthetic oligonucleotide"
acauuucucuggcagauauguuu

SEQ ID NO: 1932 - RNA, 23 nt, Artificial Sequence
  source: /note="Description of Artificial Sequence: Synthetic oligonucleotide"
uauauuucucuggcagauauguu

SEQ ID NO: 1933 - RNA, 23 nt, Artificial Sequence
  source: /note="Description of Artificial Sequence: Synthetic oligonucleotide"
cauuucucuggcagauauguuuc

SEQ ID NO: 1934 - RNA, 23 nt, Artificial Sequence
  source: /note="Description of Artificial Sequence: Synthetic oligonucleotide"
cuauauuucucuggcagauaugu

We claim:

1. A double stranded ribonucleic acid (dsRNA) agent for inhibiting expression of solute carrier family 39 member 8 (SLC39A8) in a cell, or a salt thereof,
    wherein the dsRNA agent, or a salt thereof, comprises a sense strand and an antisense strand forming a double stranded region,
    wherein the antisense strand comprises at least 19 contiguous nucleotides from any one of the antisense strand nucleotide sequences selected from the group consisting of
    5'-UGAGAAACCAUGAAGAGAAAAGA-3' of SEQ ID NO: 1465;
    5'-UAACCAUGAAGAGAAAAGAUGUC-3' of SEQ ID NO:1468;
    5'-UCAUGAAGAGAAAAGAUGUCUUC-3' of SEQ ID NO:1471;
    5'-UCCAUGAAGAGAAAAGAUGUCUU-3' of SEQ ID NO:1470;
    5'-UGAAACCAUGAAGAGAAAAGAUG-3' of SEQ ID NO:1476; and
    5'-UACCAUGAAGAGAAAAGAUGUCU-3' of SEQ ID NO:1477,
    wherein all of the nucleotides of the sense strand and all of the nucleotides of the antisense strand comprise a nucleotide modification, and
    wherein at least one strand is conjugated to a ligand.

2. The dsRNA agent, or a salt thereof, of claim 1, wherein at least one of the nucleotide modifications is selected from the group consisting of a deoxy-nucleotide modification, a 3'-terminal deoxy-thymine (dT) nucleotide modification, a 2'-O-methyl nucleotide modification, a 2'-fluoro nucleotide modification, a 2'-deoxy-nucleotide modification, a locked nucleotide modification, an unlocked nucleotide modification, a conformationally restricted nucleotide modification, a constrained ethyl nucleotide modification, an abasic nucleotide modification, a 2'-amino-nucleotide modification, a 2'-O-allyl-nucleotide modification, 2'-C-alkyl-nucleotide modification, 2'-hydroxly-nucleotide modification, a 2'-methoxyethyl nucleotide modification, a 2'-O-alkyl-nucleotide modification, a morpholino nucleotide modification, a phosphoramidate modification, a non-natural base comprising nucleotide modification, a tetrahydropyran nucleotide modification, a 1,5-anhydrohexitol nucleotide modification, a cyclohexenyl nucleotide modification, a nucleotide comprising a phosphorothioate group modification, a nucleotide comprising a methylphosphonate group modification, a nucleotide comprising a 5'-phosphate modification, a nucleotide comprising a 5'-phosphate mimic modification, a thermally destabilizing nucleotide modification, a glycol nucleotide (GNA) modification, and a 2-O—(N-methylacetamide) nucleotide modification; and combinations thereof.

3. The dsRNA agent, or a salt thereof, of claim 1, wherein the double stranded region is 19-25 nucleotide pairs in length.

4. The dsRNA agent, or a salt thereof, of claim 1, wherein each strand is independently 19-25 nucleotides in length.

5. The dsRNA agent, or a salt thereof, of claim 1, wherein at least one strand comprises a 3' overhang of at least 1 nucleotide.

6. The dsRNA agent, or a salt thereof, of claim 1, wherein the ligand is conjugated to the 3' end of the sense strand of the dsRNA agent, or a salt thereof.

7. The dsRNA agent, or a salt thereof, of claim 1, wherein the ligand is an N-acetylgalactosamine (GalNAc) derivative.

8. The dsRNA agent, or a salt thereof, of claim 1, wherein the ligand is one or more GalNAc derivatives attached through a monovalent, bivalent, or trivalent branched linker.

9. The dsRNA agent, or a salt thereof, of claim 7, wherein the ligand is

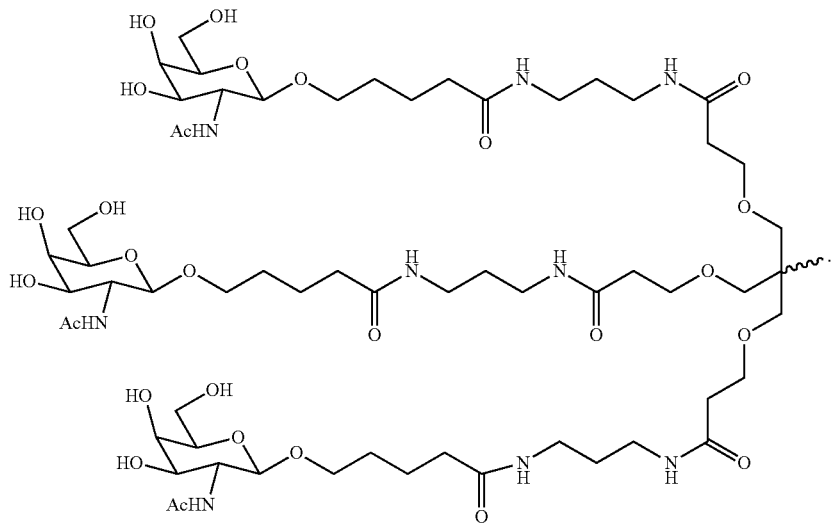 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

10. The dsRNA agent, or a salt thereof, of claim 9, wherein the dsRNA agent, or a salt thereof, is conjugated to the ligand as shown in the following schematic

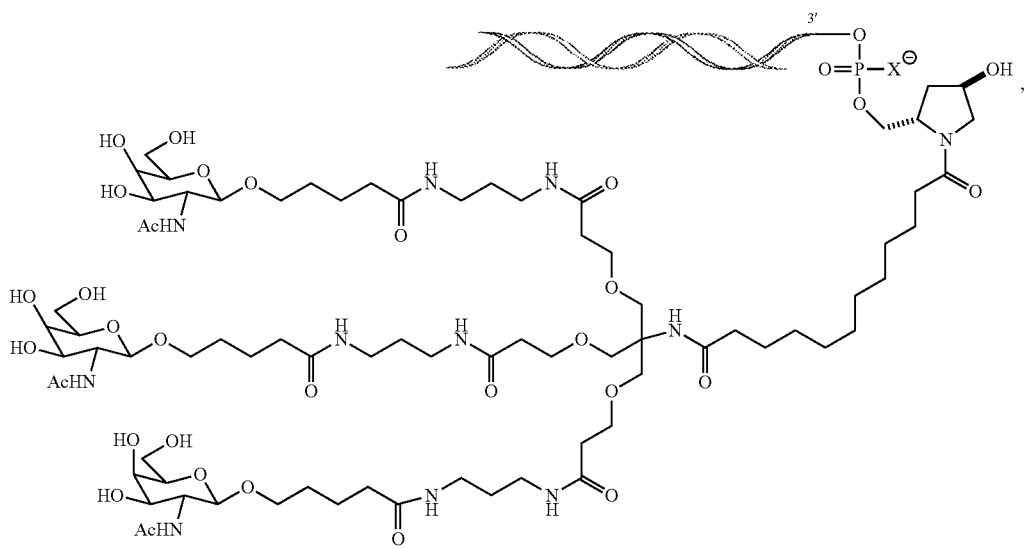

wherein X is O or S.

11. The dsRNA agent, or a salt thereof, of claim 10, wherein X is O.

12. The dsRNA agent, or a salt thereof, of claim 1, wherein the dsRNA agent, or a salt thereof, further comprises at least one phosphorothioate or methylphosphonate internucleotide linkage.

13. An isolated cell containing the dsRNA agent, or a salt thereof, of claim 1.

14. A pharmaceutical composition comprising the dsRNA agent, or a salt thereof, of claim 1.

15. The dsRNA agent, or a salt thereof, of claim 1, wherein the antisense strand comprises the nucleotide sequence 5'-UGAGAAACCAUGAAGAGAAAAGA-3' of SEQ ID NO:1465.

16. The dsRNA agent, or a salt thereof, of claim 1, wherein the sense strand comprises the nucleotide sequence 5'-UUUUCUCUUCAUGGUUUCUCA-3' of SEQ ID NO:1375 and the antisense strand comprises the nucleotide sequence 5'-UGAGAAACCAUGAAGAGAAAAGA-3' of SEQ ID NO:1465.

17. The dsRNA agent, or a salt thereof, of claim 1, wherein the sense strand comprises the nucleotide sequence 5'-CAUCUUUUCUCUUCAUGGUUA-3' of SEQ ID NO:1378 and the antisense strand comprises the nucleotide sequence 5'-UAACCAUGAAGAGAAAAGAUGUC-3' of SEQ ID NO:1468.

18. The dsRNA agent, or a salt thereof, of claim 1, wherein the sense strand comprises the nucleotide sequence 5'-AGACAUCUUUUCUCUUCAUGA-3' of SEQ ID NO:1381 and the antisense strand comprises the nucleotide sequence 5'-UCAUGAAGAGAAAAGAUGUCUUC-3' of SEQ ID NO:1471.

19. The dsRNA agent, or a salt thereof, of claim 1, wherein the sense strand comprises the nucleotide sequence 5'-GACAUCUUUUCUCUUCAUGGA-3' of SEQ ID NO:1380 and the antisense strand comprises the nucleotide sequence 5'-UCCAUGAAGAGAAAAGAUGUCUU-3' of SEQ ID NO:1470.

20. The dsRNA agent, or a salt thereof, of claim 1, wherein the sense strand comprises the nucleotide sequence 5'-UCUUUUCUCUUCAUGGUUUCA-3' of SEQ ID NO:1386 and the antisense strand comprises the nucleotide sequence 5'-UGAAACCAUGAAGAGAAAAGAUG-3' of SEQ ID NO:1476.

21. The dsRNA agent, or a salt thereof, of claim 1, wherein the sense strand comprises the nucleotide sequence 5'-ACAUCUUUUCUCUUCAUGGUA-3' of SEQ ID NO:1387 and the antisense strand comprises the nucleotide sequence 5'-UACCAUGAAGAGAAAAGAUGUCU-3' of SEQ ID NO:1477.

\* \* \* \* \*